United States Patent 12,024,727 (ENZYMES WITH RUVC DOMAINS) - sequence listing, part 2

SEQ ID NO: 2903 - protein, 146 aa, Unknown
  Description of Unknown: uncultivated organism with predicted taxonomy: Selenomonas sp. AE3005
  MG15-155 RuvC-III domain
NDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRK

SEQ ID NO: 2904 - protein, 146 aa, Unknown; identical to SEQ ID NO: 2899
  Description of Unknown: uncultivated organism with predicted taxonomy: Selenomonas sp. AE3005
  MG15-156 RuvC-III domain

SEQ ID NO: 2905 - protein, 169 aa, Unknown
  Description of Unknown: uncultivated organism with predicted taxonomy: Megasphaera stantonii
  MG15-157 RuvC-III domain
NDTKYISSFVKNLLEDHLEFAPWLTGRKRHVMAVNGAVTDYTRKRLGIRKIREDGDLHHAVDAAVIAIVTQGNIQKLTNYSKRIEHAFIKNRDGSYTHPDTGEILKKDELMAQMSRHFPEPWPGFRRELEARVSDHPKELLESLRLPTYTPEEIDALKPPFVSRMPTRK

SEQ ID NO: 2906 - protein, 158 aa, Unknown
  Description of Unknown: uncultivated organism with predicted taxonomy: Selenomonas ruminantium
  MG15-158 RuvC-III domain
NDTRYITKLVKDIIEKYLEMAPFKTTRKRNVVAVNGAVTAYVRKRLGIAKIRENGDLHHAVDAAVIACVTEGMINRISRYSKRREILYNNKLVDEETGEIIKGKEDFPEPWPWFRKELDARTGKNPALLIRDLKLPTYTEAELENLHEPYVSRMPCHK

SEQ ID NO: 2907 - protein, 158 aa, Unknown
  Description of Unknown: uncultivated organism with predicted taxonomy: Selenomonas ruminantium
  MG15-159 RuvC-III domain
NDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLTRELKLPTYAEEELENLHEPYVSRMPCHK

SEQ ID NO: 2908 - protein, 169 aa, Unknown
  Description of Unknown: uncultivated organism with predicted taxonomy: Megasphaera stantonii
  MG15-160 RuvC-III domain
NDTKYISSFVKNLLEDHLEFAPWLTGKKRHVMAVNGAVTDYTRKRLGIRKIREDGDLHHAVDAAVIAIVTQGNIQKLTNYSKRIEHAFIKNRDGSYTHPDTGEILKKGELMAQMSRHFPEPWPGFRRELEARVSDHPKALLESLRLPTYTPEELDALKPPFVSRMPTRK

SEQ ID NO: 2909 - protein, 170 aa, Unknown; identical to SEQ ID NO: 2786
  Description of Unknown: uncultivated organism with predicted taxonomy: Selenomonas sp. AE3005
  MG15-161 RuvC-III domain

SEQ ID NO: 2910 - protein, 153 aa, Unknown; identical to SEQ ID NO: 2751
  Description of Unknown: uncultivated organism with predicted taxonomy: Megasphaera
  MG15-162 RuvC-III domain

SEQ ID NO: 2911 - protein, 153 aa, Unknown
  Description of Unknown: uncultivated organism with predicted taxonomy: Megasphaera stantonii
  MG15-163 RuvC-III domain
QDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRK

SEQ ID NO: 2912 - protein, 153 aa, Unknown; identical to SEQ ID NO: 2762
  Description of Unknown: uncultivated organism with predicted taxonomy: Megasphaera
  MG15-164 RuvC-III domain

SEQ ID NO: 2913 - protein, 153 aa, Unknown; identical to SEQ ID NO: 2751
  Description of Unknown: uncultivated organism with predicted taxonomy: Megasphaera stantonii
  MG15-165 RuvC-III domain

SEQ ID NO: 2914 - protein, 162 aa, Unknown
  Description of Unknown: uncultivated organism with predicted taxonomy: Bacteroidales
  MG16-2 RuvC-III domain
RETQYIAKKSVEILKQICRNVWTTSGSVTDFLRHNWGYDEILHTLDFDRYKSGGLTEVIEIEHKGQKHRIERIKDWSKRLDHRHHAVDALVVACTKQSYIQRLNNLNTERDAMYQDIEAQSVEWKEKHSLLEKWIKLQPHPTVSEVTDKVDEILVSFKAGKR

SEQ ID NO: 2915 - protein, 165 aa, Unknown
  Description of Unknown: uncultivated organism with predicted taxonomy: Bacteroidales
  MG16-5 RuvC-III domain
LQSQYIAKKAAEILRQGYRNVYATSGSVTDFLRHQWGYDEILHRLNLPRYQQVEGLTEDVTYDHCGQEHQQERIKGWTKRLDHRHHAIDALTIALTQQSVIQRLNTLNNSREQMFDELGKRTDTPEYTEKRSLLEKWVDAQPHFSVQEVTDKVDGILVSFRAGKR

SEQ ID NO: 2916 - protein, 165 aa, Unknown; identical to SEQ ID NO: 2915
  Description of Unknown: uncultivated organism with predicted taxonomy: Bacteroidetes
  MG16-6 RuvC-III domain

SEQ ID NO: 2917 - protein, 150 aa, Unknown
  Description of Unknown: uncultivated organism with predicted taxonomy: Bacteroides
  MG16-7 RuvC-III domain
VQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKK

SEQ ID NO: 2918 - protein, 150 aa, Unknown; identical to SEQ ID NO: 2917
  Description of Unknown: uncultivated organism with predicted taxonomy: Bacteroides
  MG16-8 RuvC-III domain

SEQ ID NO: 2919 - protein, 150 aa, Unknown; identical to SEQ ID NO: 2917
  Description of Unknown: uncultivated organism with predicted taxonomy: Bacteroides sp. CAG:770
  MG16-9 RuvC-III domain

SEQ ID NO: 2920 - protein, 150 aa, Unknown; identical to SEQ ID NO: 2917
  Description of Unknown: uncultivated organism with predicted taxonomy: Bacteroides
  MG16-10 RuvC-III domain

SEQ ID NO: 2921 - protein, 150 aa, Unknown; identical to SEQ ID NO: 2917
  Description of Unknown: uncultivated organism with predicted taxonomy: Bacteroides
  MG16-11 RuvC-III domain

SEQ ID NO: 2922 - protein, 165 aa, Unknown; identical to SEQ ID NO: 2915
  Description of Unknown: uncultivated organism with predicted taxonomy: Bacteroidetes
  MG16-12 RuvC-III domain

SEQ ID NO: 2923 - protein, 150 aa, Unknown; identical to SEQ ID NO: 2917
  Description of Unknown: uncultivated organism with predicted taxonomy: Bacteroides
  MG16-13 RuvC-III domain

SEQ ID NO: 2924 - protein, 150 aa, Unknown; identical to SEQ ID NO: 2917
  Description of Unknown: uncultivated organism with predicted taxonomy: Bacteroides sp. CAG:770
  MG16-14 RuvC-III domain

SEQ ID NO: 2925 - protein, 150 aa, Unknown
  Description of Unknown: uncultivated organism with predicted taxonomy: Bacteroides sp. CAG:770
  MG16-15 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2926 - protein, 150 aa, Unknown
  Description of Unknown: uncultivated organism with predicted taxonomy: Bacteroides sp. CAG:709
  MG16-16 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKK

SEQ ID NO: 2927 - protein, 150 aa, Unknown
  Description of Unknown: uncultivated organism with predicted taxonomy: Bacteroides sp. CAG:770
  MG16-17 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTQQSIIQRLNNLSAMTAVAGESMSLDKWTLAQPHFSVQKVSDNVSRILVSFKAGKK

SEQ ID NO: 2928 - protein, 150 aa, Unknown
  Description of Unknown: uncultivated organism with predicted taxonomy: Bacteroides sp. CAG:770
  MG16-18 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKTAIGEEQISLDKWTLAQAHFSVADVADHVADILVSFKSGKK

SEQ ID NO: 2929 - protein, 150 aa, Unknown
  Description of Unknown: uncultivated organism with predicted taxonomy: Bacteroides sp. CAG:770
  MG16-19 RuvC-III domain
VQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKR

SEQ ID NO: 2930 - protein, 150 aa, Unknown
  Description of Unknown: uncultivated organism with predicted taxonomy: Bacteroides sp. CAG:770
  MG16-20 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKK

SEQ ID NO: 2931 - protein, 150 aa, Unknown
  Description of Unknown: uncultivated organism with predicted taxonomy: Bacteroides sp. CAG:770
  MG16-21 RuvC-III domain
VQTQYVSRKAMEILNQVCRNVYGSSGDVTAYLRRIWGYDEILHSLDLPRYREGNLTGNVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2932 - protein, 150 aa, Unknown
  Description of Unknown: uncultivated organism with predicted taxonomy: Bacteroides sp. CAG:770
  MG16-22 RuvC-III domain
VQTQYISRKAMEILNQVCRNVYGSSGDVTAYLRRIWGYDEILHSLDLPRYRKGNLTGDVTYVHKGQTHTEERIKDWSKRLDHRHHAIDALTIACTRQSIIQRLNTLNAKTAIGEEQMSLDKWTLAQAHFSVADVADHVADILVSFKSGKR

SEQ ID NO: 2933 - protein, 150 aa, Unknown
  Description of Unknown: uncultivated organism with predicted taxonomy: Bacteroidales
  MG16-23 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNRSAMTAVAGESMSLDKWTLAQPHFSVQEVSDNVSRILVSFKAGKK

SEQ ID NO: 2934 - protein, 150 aa, Unknown
  Description of Unknown: uncultivated organism with predicted taxonomy: Bacteroides sp. CAG:770
  MG16-24 RuvC-III domain
VQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2935 - protein, 150 aa, Unknown
  Description of Unknown: uncultivated organism with predicted taxonomy: Bacteroides sp. CAG:770
  MG16-25 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKK

SEQ ID NO: 2936 - protein, 150 aa, Unknown; identical to SEQ ID NO: 2925
  Description of Unknown: uncultivated organism with predicted taxonomy: Bacteroides
  MG16-26 RuvC-III domain

SEQ ID NO: 2937 - protein, 150 aa, Unknown
  Description of Unknown: uncultivated organism with predicted taxonomy: Bacteroides sp. CAG:770
  MG16-27 RuvC-III domain
VQTQYISRKAMEILDQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 2938 - protein, 150 aa, Unknown
  Description of Unknown: uncultivated organism with predicted taxonomy: Bacteroides sp. CAG:545
  MG16-28 RuvC-III domain
VQTQYISRKAMEILKQVCHNVYGSSGEVTSYLRRIWGYDEILHTLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2939 - protein, 150 aa, Unknown
  Description of Unknown: uncultivated organism with predicted taxonomy: Bacteroides sp. CAG:709
  MG16-29 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 2940 - protein, 150 aa, Unknown; identical to SEQ ID NO: 2939
  Description of Unknown: uncultivated organism with predicted taxonomy: Bacteroides sp. CAG:709
  MG16-30 RuvC-III domain

SEQ ID NO: 2941 - protein, 150 aa, Unknown; identical to SEQ ID NO: 2939
  Description of Unknown: uncultivated organism with predicted taxonomy: Bacteroides sp. CAG:709
  MG16-31 RuvC-III domain

SEQ ID NO: 2942 - protein, 150 aa, Unknown
  Description of Unknown: uncultivated organism with predicted taxonomy: Alistipes sp. CAG:514
  MG16-32 RuvC-III domain
VQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKK

SEQ ID NO: 2943 - protein, 150 aa, Unknown; identical to SEQ ID NO: 2942
  Description of Unknown: uncultivated organism with predicted taxonomy: Alistipes sp. CAG:514
  MG16-33 RuvC-III domain

SEQ ID NO: 2944 - protein, 150 aa, Unknown; identical to SEQ ID NO: 2925
  Description of Unknown: uncultivated organism with predicted taxonomy: Bacteroides sp. CAG:545
  MG16-34 RuvC-III domain

SEQ ID NO: 2945 - protein, 150 aa, Unknown
  Description of Unknown: uncultivated organism with predicted taxonomy: Bacteroides sp. CAG:770
  MG16-35 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIACTRQSIIQKLNTLNAKTAIGEEQISLDKWTLAQAHFSVADVADHVADILVSFKSGKK

SEQ ID NO: 2946 - protein, 150 aa, Unknown
  Description of Unknown: uncultivated organism with predicted taxonomy: Bacteroides
  MG16-36 RuvC-III domain
VQTQYISRKAMEILKQVCHNVYGSSGEVTSYLRRIWGYDKILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2947 - protein, 150 aa, Unknown; identical to SEQ ID NO: 2925
  Description of Unknown: uncultivated organism with predicted taxonomy: Bacteroides sp. CAG:545
  MG16-37 RuvC-III domain

SEQ ID NO: 2948 - protein, 150 aa, Unknown; identical to SEQ ID NO: 2946
  Description of Unknown: uncultivated organism with predicted taxonomy: Bacteroides
  MG16-38 RuvC-III domain

SEQ ID NO: 2949 - protein, 150 aa, Unknown; identical to SEQ ID NO: 2929
  Description of Unknown: uncultivated organism with predicted taxonomy: Bacteroides sp. CAG:770
  MG16-39 RuvC-III domain

SEQ ID NO: 2950 - protein, 150 aa, Unknown
  Description of Unknown: uncultivated organism with predicted taxonomy: Bacteroides sp. CAG:770
  MG16-40 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSIIQRLNNLSSMTAVAGEAMSLDKWTLAQPHFSVQEVSDKVGGILVSFKAGKK

SEQ ID NO: 2951 - protein, 150 aa, Unknown
  Description of Unknown: uncultivated organism with predicted taxonomy: Bacteroides sp. CAG:770
  MG16-42 RuvC-III domain
VQTQYISRKAMEILNQVCRNVYGSSGDVTAYLRRIWGYDEILHSLDLPRYREGNLTGDVTYVHMGQTHTEERIKDWSKRLDHRHHAIDALTIACTRQSIIQRLNTLNAKTAIGEEQMSLDKWTLAQAHFSVADVSDHVADILVSFKSGKK

SEQ ID NO: 2952 - protein, 150 aa, Unknown; identical to SEQ ID NO: 2951
  Description of Unknown: uncultivated organism with predicted taxonomy: Bacteroides sp. CAG:770
  MG16-43 RuvC-III domain

SEQ ID NO: 2953 - protein, 150 aa, Unknown
  Description of Unknown: uncultivated organism with predicted taxonomy: Bacteroides sp. CAG:770
  MG16-44 RuvC-III domain
VQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2954 - protein, 150 aa, Unknown; identical to SEQ ID NO: 2945
  Description of Unknown: uncultivated organism with predicted taxonomy: Bacteroides sp. CAG:770
  MG16-45 RuvC-III domain

SEQ ID NO: 2955 - protein, 150 aa, Unknown; identical to SEQ ID NO: 2925
  Description of Unknown: uncultivated organism with predicted taxonomy: Bacteroides sp. CAG:770
  MG16-46 RuvC-III domain

SEQ ID NO: 2956 - protein, 150 aa, Unknown; identical to SEQ ID NO: 2939
  Description of Unknown: uncultivated organism with predicted taxonomy: Bacteroides sp. CAG:709
  MG16-47 RuvC-III domain

SEQ ID NO: 2957 - protein, 150 aa, Unknown
  Description of Unknown: uncultivated organism with predicted taxonomy: Bacteroides sp. CAG:770
  MG16-48 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKK

SEQ ID NO: 2958 - protein, 150 aa, Unknown; identical to SEQ ID NO: 2957
  Description of Unknown: uncultivated organism with predicted taxonomy: Bacteroides sp. CAG:770
  MG16-50 RuvC-III domain

SEQ ID NO: 2959 - protein, 150 aa, Unknown; identical to SEQ ID NO: 2957
  Description of Unknown: uncultivated organism with predicted taxonomy: Bacteroides sp. CAG:770
  MG16-51 RuvC-III domain

SEQ ID NO: 2960 - protein, 150 aa, Unknown
  Description of Unknown: uncultivated organism with predicted taxonomy: Bacteroides sp. CAG:770
  MG16-52 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKK

SEQ ID NO: 2961 - protein, 150 aa, Unknown; identical to SEQ ID NO: 2939
  Description of Unknown: uncultivated organism with predicted taxonomy: Bacteroides sp. CAG:709
  MG16-53 RuvC-III domain

SEQ ID NO: 2962 - protein, 150 aa, Unknown; identical to SEQ ID NO: 2939
  Description of Unknown: uncultivated organism with predicted taxonomy: Bacteroides sp. CAG:709
  MG16-54 RuvC-III domain

SEQ ID NO: 2963 - protein, 150 aa, Unknown
  Description of Unknown: uncultivated organism with predicted taxonomy: Bacteroides sp. CAG:770
  MG16-55 RuvC-III domain
VQTQYISRKAMDILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKAAIGEEQMSLDKWTLAQAHFSVADVADHVADILVSFKSGKK

SEQ ID NO: 2964 - protein, 150 aa, Unknown; identical to SEQ ID NO: 2925
  Description of Unknown: uncultivated organism with predicted taxonomy: Bacteroides sp. CAG:545
  MG16-56 RuvC-III domain

SEQ ID NO: 2965 - protein, 150 aa, Unknown; identical to SEQ ID NO: 2929
  Description of Unknown: uncultivated organism with predicted taxonomy: Bacteroides sp. CAG:770
  MG16-57 RuvC-III domain

SEQ ID NO: 2966 - protein, 150 aa, Unknown
  Description of Unknown: uncultivated organism with predicted taxonomy: Bacteroides sp. CAG:770
  MG16-58 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKR

SEQ ID NO: 2967 - protein, 150 aa, Unknown
  Description of Unknown: uncultivated organism with predicted taxonomy: Bacteroides sp. CAG:770
  MG16-59 RuvC-III domain
VQTQYISRKAMEILKQVCHNVYGSSGEVTSYLRRIWGYDEILHSLDLPRYREGGMTAEVSYDHRGQTHTEERIKDWSKRLEHRHHAIDALTIACTRQSIIQRLNNLSAMTAVAGESMSLDKWTLAQPHFSVQEVSDNVSRILVSFKAGKK

SEQ ID NO: 2968 - protein, 150 aa, Unknown; identical to SEQ ID NO: 2925
  Description of Unknown: uncultivated organism with predicted taxonomy: Bacteroides sp. CAG:770
  MG16-60 RuvC-III domain

SEQ ID NO: 2969 - protein, 150 aa, Unknown; identical to SEQ ID NO: 2939
  Description of Unknown: uncultivated organism with predicted taxonomy: Bacteroides sp. CAG:709
  MG16-61 RuvC-III domain

SEQ ID NO: 2970 - protein, 150 aa, Unknown; identical to SEQ ID NO: 2925
  Description of Unknown: uncultivated organism with predicted taxonomy: Bacteroides sp. CAG:770
  MG16-62 RuvC-III domain

SEQ ID NO: 2971 - protein, 150 aa, Unknown; identical to SEQ ID NO: 2925
  Description of Unknown: uncultivated organism with predicted taxonomy: Bacteroides sp. CAG:770
  MG16-63 RuvC-III domain

SEQ ID NO: 2972 - protein, 150 aa, Unknown; identical to SEQ ID NO: 2942
  Description of Unknown: uncultivated organism with predicted taxonomy: Alistipes sp. CAG:514
  MG16-64 RuvC-III domain

SEQ ID NO: 2973 - protein, 150 aa, Unknown
  Description of Unknown: uncultivated organism with predicted taxonomy: Bacteroides sp. CAG:770
  MG16-65 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 2974 - protein, 150 aa, Unknown
  Description of Unknown: uncultivated organism with predicted taxonomy: Bacteroides sp. CAG:770
  MG16-66 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGEYMSLDKWTLAQPHFSVQEVSDNVSRILVSFKAGKK

SEQ ID NO: 2975 - protein, 150 aa, Unknown; identical to SEQ ID NO: 2925
  Description of Unknown: uncultivated organism with predicted taxonomy: Bacteroides sp. CAG:545
  MG16-67 RuvC-III domain

SEQ ID NO: 2976 - protein, 150 aa, Unknown; identical to SEQ ID NO: 2930
  Description of Unknown: uncultivated organism with predicted taxonomy: Bacteroides sp. CAG:770
  MG16-68 RuvC-III domain

SEQ ID NO: 2977 - protein, 150 aa, Unknown; identical to SEQ ID NO: 2939
  Description of Unknown: uncultivated organism with predicted taxonomy: Bacteroides sp. CAG:709
  MG16-69 RuvC-III domain

SEQ ID NO: 2978 - protein, 150 aa, Unknown; identical to SEQ ID NO: 2925
  Description of Unknown: uncultivated organism with predicted taxonomy: Bacteroides sp. CAG:770
  MG16-70 RuvC-III domain

SEQ ID NO: 2979 - protein, 150 aa, Unknown; identical to SEQ ID NO: 2938
  Description of Unknown: uncultivated organism with predicted taxonomy: Bacteroides sp. CAG:545
  MG16-72 RuvC-III domain

SEQ ID NO: 2980 - protein, 150 aa, Unknown; identical to SEQ ID NO: 2925
  Description of Unknown: uncultivated organism with predicted taxonomy: Bacteroides sp. CAG:545
  MG16-73 RuvC-III domain

SEQ ID NO: 2981 - protein, 150 aa, Unknown
  Description of Unknown: uncultivated organism with predicted taxonomy: Bacteroides sp. CAG:770
  MG16-74 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNANTAIGEEQISLDKWTLAQAHFSVADVADHVADILVSFKSGKK

SEQ ID NO: 2982 - protein, 150 aa, Unknown; identical to SEQ ID NO: 2939
  Description of Unknown: uncultivated organism with predicted taxonomy: Bacteroides sp. CAG:709
  MG16-75 RuvC-III domain

SEQ ID NO: 2983 - protein, 150 aa, Unknown; identical to SEQ ID NO: 2939
  Description of Unknown: uncultivated organism with predicted taxonomy: Bacteroides
  MG16-76 RuvC-III domain

SEQ ID NO: 2984 - protein, 150 aa, Unknown
  Description of Unknown: uncultivated organism with predicted taxonomy: Bacteroides sp. CAG:770
  MG16-77 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKR

SEQ ID NO: 2985 - protein, 150 aa, Unknown; identical to SEQ ID NO: 2925
  Description of Unknown: uncultivated organism with predicted taxonomy: Bacteroides
  MG16-78 RuvC-III domain

SEQ ID NO: 2986 - protein, 150 aa, Unknown
  Description of Unknown: uncultivated organism with predicted taxonomy: Bacteroides sp. CAG:770
  MG16-79 RuvC-III domain
IQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 2987 - protein, 150 aa, Unknown; identical to SEQ ID NO: 2925
  Description of Unknown: uncultivated organism with predicted taxonomy: Bacteroides sp. CAG:545
  MG16-80 RuvC-III domain

SEQ ID NO: 2988 - protein, 150 aa, Unknown
  Description of Unknown: uncultivated organism with predicted taxonomy: Bacteroides
  MG16-81 RuvC-III domain
VQTQYISRKAMEILKQVCHNVYGSSGEVTSYLRRIWGYDVILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 2989 - protein, 150 aa, Unknown; identical to SEQ ID NO: 2930
  Description of Unknown: uncultivated organism with predicted taxonomy: Bacteroides sp. CAG:770
  MG16-82 RuvC-III domain

SEQ ID NO: 2990 - protein, 150 aa, Unknown; identical to SEQ ID NO: 2925
  Description of Unknown: uncultivated organism with predicted taxonomy: Bacteroides sp. CAG:545
  MG16-83 RuvC-III domain

SEQ ID NO: 2991 - protein, 165 aa, Unknown
  Description of Unknown: uncultivated organism with predicted taxonomy: Bacteroidetes
  MG16-84 RuvC-III domain
RQSQYIAKKAAEILRQGVRNVYATSGSVTDFLRHQWGYDNILHYLNLPRYQQVDGLTESVTYDHCGQKHQEERIKDWTKRLDHRHHAIDALTIALTQQSVIQRLNTLNASREEMKNDLGQRIDTPEYTEKRSLLEKWVDIQPHFSVQEVTDKVDGILISFRAGKR

SEQ ID NO: 2992 - protein, 150 aa, Unknown; identical to SEQ ID NO: 2925
  Description of Unknown: uncultivated organism with predicted taxonomy: Bacteroides
  MG16-85 RuvC-III domain

SEQ ID NO: 2993 - protein, 150 aa, Unknown
  Description of Unknown: uncultivated organism with predicted taxonomy: Bacteroides sp. CAG:545
  MG16-86 RuvC-III domain
VQTQYISRKAMEILKQVCHNVYGSSGEVTSYLRRIWGYDEILHSLDLPRYREGGMTAEVSYDHLGQTHTEERIKDWSKRLDHRHHAIDALTIACTRQSIIQRLNNLSAMSAVAGESMSLDKWTLAQPHFSVQEVSDNVSRILVSFKAGKK

SEQ ID NO: 2994 - protein, 150 aa, Unknown; identical to SEQ ID NO: 2993
  Description of Unknown: uncultivated organism with predicted taxonomy: Bacteroides
  MG16-87 RuvC-III domain

SEQ ID NO: 2995 - protein, 150 aa, Unknown; identical to SEQ ID NO: 2926
  Description of Unknown: uncultivated organism with predicted taxonomy: Bacteroides
  MG16-88 RuvC-III domain

SEQ ID NO: 2996 - protein, 150 aa, Unknown; identical to SEQ ID NO: 2939
  Description of Unknown: uncultivated organism with predicted taxonomy: Bacteroides sp. CAG:709
  MG16-89 RuvC-III domain

SEQ ID NO: 2997 - protein, 150 aa, Unknown; identical to SEQ ID NO: 2966
  Description of Unknown: uncultivated organism with predicted taxonomy: Bacteroides sp. CAG:770
  MG16-90 RuvC-III domain

SEQ ID NO: 2998 - protein, 150 aa, Unknown; identical to SEQ ID NO: 2966
  Description of Unknown: uncultivated organism with predicted taxonomy: Bacteroides sp. CAG:770
  MG16-91 RuvC-III domain

SEQ ID NO: 2999 - protein, 150 aa, Unknown; identical to SEQ ID NO: 2942
  Description of Unknown: uncultivated organism with predicted taxonomy: Alistipes sp. CAG:514
  MG16-92 RuvC-III domain

SEQ ID NO: 3000 - protein, 150 aa, Unknown; identical to SEQ ID NO: 2942
  Description of Unknown: uncultivated organism with predicted taxonomy: Alistipes sp. CAG:514
  MG16-93 RuvC-III domain

SEQ ID NO: 3001 - protein, 150 aa, Unknown
  Description of Unknown: uncultivated organism with predicted taxonomy: Bacteroides sp. CAG:545
  MG16-94 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSYNVSRILVSFKAGKK

SEQ ID NO: 3002 - protein, 150 aa, Unknown
  Description of Unknown: uncultivated organism with predicted taxonomy: Bacteroides sp. CAG:709
  MG16-95 RuvC-III domain
VQTQYISRKAMEILKQVCHNVYGSSGEVTSYLRRIWGYDEILHSLDLPRYREGGMTAEVSYEHRGQIHTEERIKDWSKRLDHRHHAIDALTIACTRQSVIQRLNNLSSMTAVAGEAMSLDKWTLAQPHFSVQEVSDKVGGILVSFKAGKK

SEQ ID NO: 3003 - protein, 150 aa, Unknown; identical to SEQ ID NO: 2925
  Description of Unknown: uncultivated organism with predicted taxonomy: Bacteroides
  MG16-96 RuvC-III domain

SEQ ID NO: 3004 - protein, 150 aa, Unknown; identical to SEQ ID NO: 2925
  Description of Unknown: uncultivated organism with predicted taxonomy: Bacteroides
  MG16-97 RuvC-III domain

SEQ ID NO: 3005 - protein, 150 aa, Unknown
  Description of Unknown: uncultivated organism with predicted taxonomy: Bacteroides sp. CAG:770
  MG16-98 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 3006 - protein, 150 aa, Unknown; identical to SEQ ID NO: 2939
  Description of Unknown: uncultivated organism with predicted taxonomy: Bacteroides sp. CAG:709
  MG16-99 RuvC-III domain

SEQ ID NO: 3007 - protein, 150 aa, Unknown; identical to SEQ ID NO: 2939
  Description of Unknown: uncultivated organism with predicted taxonomy: Bacteroides sp. CAG:709
  MG16-100 RuvC-III domain

SEQ ID NO: 3008 - protein, 150 aa, Unknown
  Description of Unknown: uncultivated organism with predicted taxonomy: Bacteroides sp. CAG:545
  MG16-101 RuvC-III domain
VQTQYISRKAMEILKQVCHNVYGSSGEVTSYLRRIWGYDEILHSLDLPRYREGGMTSEVSYDHRGQTHTEERIKDWSKRLDHRHHAIDALTIACTRQSIIQRLNNLSAMTAVAGESMSLDKWTLAQPHFSVQEVSDNVSRILVSFKAGKK

SEQ ID NO: 3009 - protein, 150 aa, Unknown
  Description of Unknown: uncultivated organism with predicted taxonomy: Bacteroides sp. CAG:770
  MG16-102 RuvC-III domain
VQTQYISRKAMEILNQVCRNVYCSSGDVTAYLRRIWGYDEILHSLDLPRYREGNLTGDVTYVHMGQTHTEERIKDWSKRMDHRHHAIDALTIACTRQSIIQRLNTLNAKTAIGEEQMSLDKWTLAQAHFSVADVADHVADILVSFKSGKR

SEQ ID NO: 3010 - protein, 150 aa, Unknown; identical to SEQ ID NO: 2953
  Description of Unknown: uncultivated organism with predicted taxonomy: Bacteroides sp. CAG:770
  MG16-103 RuvC-III domain

SEQ ID NO: 3011 - protein, 150 aa, Unknown; identical to SEQ ID NO: 2939
  Description of Unknown: uncultivated organism with predicted taxonomy: Bacteroides
  MG16-104 RuvC-III domain

SEQ ID NO: 3012 - protein, 150 aa, Unknown
  Description of Unknown: uncultivated organism with predicted taxonomy: Bacteroides sp. CAG:770
  MG16-105 RuvC-III domain
VQTQYISRKAMEILNQVCRNVYGSSGDVTAYLRRIWGYDEILHSLDLPRYREGNLTENVTYVHRGQTHTEERIKDWSKRLDHRHHAIDALTIACTRQSIIQRLNTLNAKTAIGEEQMSLDKWTLAQTHFSVADVADHVADILVSFKSGKR

SEQ ID NO: 3013 - protein, 150 aa, Unknown; identical to SEQ ID NO: 2925
  Description of Unknown: uncultivated organism with predicted taxonomy: Bacteroides sp. CAG:545
  MG16-106 RuvC-III domain

SEQ ID NO: 3014 - protein, 150 aa, Unknown; identical to SEQ ID NO: 2925
  Description of Unknown: uncultivated organism with predicted taxonomy: Bacteroides sp. CAG:545
  MG16-107 RuvC-III domain

SEQ ID NO: 3015 - protein, 150 aa, Unknown; identical to SEQ ID NO: 2932
  Description of Unknown: uncultivated organism with predicted taxonomy: Bacteroides sp. CAG:770
  MG16-108 RuvC-III domain

SEQ ID NO: 3016 - protein, 150 aa, Unknown; identical to SEQ ID NO: 2939
  Description of Unknown: uncultivated organism with predicted taxonomy: Bacteroides sp. CAG:709
  MG16-109 RuvC-III domain

SEQ ID NO: 3017 - protein, 150 aa, Unknown; identical to SEQ ID NO: 2939
  Description of Unknown: uncultivated organism with predicted taxonomy: Bacteroides sp. CAG:709
  MG16-110 RuvC-III domain

SEQ ID NO: 3018 - protein, 150 aa, Unknown; identical to SEQ ID NO: 2925
  Description of Unknown: uncultivated organism with predicted taxonomy: Bacteroides sp. CAG:770
  MG16-113 RuvC-III domain

SEQ ID NO: 3019 - protein, 150 aa, Unknown; identical to SEQ ID NO: 2925
  Description of Unknown: uncultivated organism with predicted taxonomy: Bacteroides sp. CAG:545
  MG16-114 RuvC-III domain

SEQ ID NO: 3020 - protein, 150 aa, Unknown; identical to SEQ ID NO: 2925
  Description of Unknown: uncultivated organism with predicted taxonomy: Bacteroides sp. CAG:770
  MG16-115 RuvC-III domain

SEQ ID NO: 3021 - protein, 150 aa, Unknown; identical to SEQ ID NO: 2925
  Description of Unknown: uncultivated organism with predicted taxonomy: Bacteroides
  MG16-116 RuvC-III domain

SEQ ID NO: 3022 - protein, 150 aa, Unknown; identical to SEQ ID NO: 2973
  Description of Unknown: uncultivated organism with predicted taxonomy: Bacteroides sp. CAG:770
  MG16-118 RuvC-III domain

SEQ ID NO: 3023 - protein, 150 aa, Unknown; identical to SEQ ID NO: 2939
  Description of Unknown: uncultivated organism with predicted taxonomy: Bacteroides sp. CAG:709
  MG16-119 RuvC-III domain

SEQ ID NO: 3024 - protein, 150 aa, Unknown; identical to SEQ ID NO: 2939
  Description of Unknown: uncultivated organism with predicted taxonomy: Bacteroides sp. CAG:709
  MG16-120 RuvC-III domain

SEQ ID NO: 3025 - protein, 150 aa, Unknown
  Description of Unknown: uncultivated organism with predicted taxonomy: Bacteroides sp. CAG:770
  MG16-121 RuvC-III domain
VQTQYISRKAMEILNQVCRNVYGSSGDVTAYLRRIWGYDEILHSLDLPRYREGNLTGDVTYLHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 3026 - protein, 150 aa, Unknown
  Description of Unknown: uncultivated organism with predicted taxonomy: Bacteroides sp. CAG:770
  MG16-122 RuvC-III domain
VQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKR

SEQ ID NO: 3027 - protein, 150 aa, Unknown; identical to SEQ ID NO: 2925
  Description of Unknown: uncultivated organism with predicted taxonomy: Bacteroides sp. CAG:545
  MG16-123 RuvC-III domain

SEQ ID NO: 3028 - protein, 150 aa, Unknown
  Description of Unknown: uncultivated organism with predicted taxonomy: Bacteroides sp. CAG:770
  MG16-126 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMAAVAGESMSLDKWTLAQPHFSVQEVSDNVSRILVSFKAGKK

SEQ ID NO: 3029 - protein, 150 aa, Unknown; identical to SEQ ID NO: 2939
  Description of Unknown: uncultivated organism with predicted taxonomy: Bacteroides sp. CAG:709
  MG16-127 RuvC-III domain

SEQ ID NO: 3030 - protein, 150 aa, Unknown; identical to SEQ ID NO: 2925
  Description of Unknown: uncultivated organism with predicted taxonomy: Bacteroides sp. CAG:770
  MG16-128 RuvC-III domain

SEQ ID NO: 3031 - protein, 150 aa, Unknown; identical to SEQ ID NO: 2939
  Description of Unknown: uncultivated organism with predicted taxonomy: Bacteroides sp. CAG:709
  MG16-129 RuvC-III domain

SEQ ID NO: 3032 - protein, 150 aa, Unknown
  Description of Unknown: uncultivated organism with predicted taxonomy: Bacteroides sp. CAG:770
  MG16-130 RuvC-III domain
VQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKK

SEQ ID NO: 3033 - protein, 150 aa, Unknown
  Description of Unknown: uncultivated organism with predicted taxonomy: Bacteroides sp. CAG:709
  MG16-131 RuvC-III domain
VQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSMQEVSDKVGGILVSFKAGKK

SEQ ID NO: 3034 - protein, 150 aa, Unknown; identical to SEQ ID NO: 2925
  Description of Unknown: uncultivated organism with predicted taxonomy: Bacteroides
  MG16-132 RuvC-III domain

SEQ ID NO: 3035 - protein, 159 aa, Unknown
  Description of Unknown: uncultivated organism with predicted taxonomy: Bacteroidales
  MG16-133 RuvC-III domain
RLSQYISKKAQELLKKSCREVIATSGSVTDLIRHTWGYDTILHELNLPCYKEAGLTTFIKEENTGQQKEVIKDWTKRLDHRHHAVDALTVACTSRSIIQHINTLHASREVMRGDVKTPRKEWENNDLLQQWIKEKMPFDRQYVLQKVASILVSMKSGKK

SEQ ID NO: 3036 - protein, 166 aa, Unknown
  Description of Unknown: uncultivated organism
  MG16-134 RuvC-III domain
GETQYISREAIKILKQCCKNVNATSGAVTAILRHLWGYDEILHQLDFERYKKAGLTKIVTWESDHGKNKHTKEQIVNWTKRIDHRHHAIDALVIACTQQGFVQRINTLNADETKDLMKKQIESSGVKFEEKKDLLNKYLASLTPFSTQTVADNVDKILVSFKAGKK

SEQ ID NO: 3037 - protein, 166 aa, Unknown
  Description of Unknown: uncultivated organism with predicted taxonomy: Porphyromonas sp. oral taxon 278
  MG16-135 RuvC-III domain
GETQYISREAIRILKQCCRYVNATSGSITATLRHLWGYDEILHQLNFERYKQAGLTKIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKK

SEQ ID NO: 3038 - protein, 162 aa, Unknown
  Description of Unknown: uncultivated organism with predicted taxonomy: Bacteroidales
  MG16-136 RuvC-III domain
RQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKM

SEQ ID NO: 3039 - protein, 159 aa, Unknown
  Description of Unknown: uncultivated organism with predicted taxonomy: Prevotella
  MG16-137 RuvC-III domain
RLSQYISRKAQELLRMTCRDVTVTTGEITALIRHTWGYDTILHDLNFSSYKEAGLTEIVKGEDSGRTREIIKDWSKRLDHRHHAIDALAVACTSRSIVQRINTLNASREEIRGEIKAPRKEWKDSNLLQQWIKEKMPFDRQYVLHKVASILISMKAGKK

SEQ ID NO: 3040 - protein, 162 aa, Unknown
  Description of Unknown: uncultivated organism
  MG16-138 RuvC-III domain
RQSQYISKKAVEMLKQVCRNVWTTSGSVTDFIRHQWGYDNILHDLNFKRYKDAGQTEIIISDHLGQVHQEERIKNWTKRLDHRHHAIDALTIASTKQSYIQRLNHLNSSRDKMFQELEAQSKEVKEKYSLLESWMRCRPHIPVSVVSQAIDGILVSFKTGKR

SEQ ID NO: 3041 - protein, 163 aa, Unknown
  Description of Unknown: uncultivated organism with predicted taxonomy: Bacteroidales
  MG16-139 RuvC-III domain
RQSQYIAVKAVEILQQGIRRVWTSGGSVTDFLRHQWGYDEILHTLNLPRYKQVDEMTEWVHYEHAGQEHEVERIKNWTKRLDHRHHAIDALTVALTQQSMIQRLNTLEASHDEMEKQVKEANTPYKEKKSILEKWVTEQPHFEVSEVTDKVDSILVSFRAGKR

SEQ ID NO: 3042 - protein, 126 aa, Unknown
  Description of Unknown: uncultivated organism with predicted taxonomy: Fibrobacter
  MG16-140 RuvC-III domain
RQTQYIAKKALEMLKEICYNVYATSGSVTDFIRRTWGYDEILHQLNFDRYKKGGLTELREYEHKGETHTEERIQDWSKRLDHRHHAIDALVIAMTRQSIIQRLNHLNTERDAMFQEVEKQRKDWKN

SEQ ID NO: 3043 - protein, 100 aa, Unknown
  Description of Unknown: uncultivated organism with predicted taxonomy: Bacteroidales
  MG16-141 RuvC-III domain
RQSQYIAVKAVEILQQGIRQVWTSGGSVTDFLRHQWGYDEILHTLNLPRYRKVEDLTEIVHYEHAGQEHDEERIKNWSKRIDHRHHAIDALTVALTRQAY

SEQ ID NO: 3044 - protein, 163 aa, Unknown
  Description of Unknown: uncultivated organism with predicted taxonomy: Bacteroidales
  MG16-142 RuvC-III domain
RQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKR

SEQ ID NO: 3045 - protein, 162 aa, Unknown
  Description of Unknown: uncultivated organism with predicted taxonomy: Deminuibacter soli
  MG16-143 RuvC-III domain
RQSQYIAKKAVDMLKQVCRNVWTTSGSVTDFLRHNWGYDQILHDLNLPRYKEGGMTEMVHYEHNGQEHDEERIIGWTKRLDHRHHAIDALTIASTRQSYIQRLNTLYASRDAMHAEIKKQSAHWQEKHSLLEEWTKQRPHLPVSVVRDSVDGILVSFKPGKR

SEQ ID NO: 3046 - protein, 166 aa, Unknown
  Description of Unknown: uncultivated organism with predicted taxonomy: Bacteroidales
  MG16-144 RuvC-III domain
GETQYISRESIRILKQCCRNVNATSGSITATLRHLWGYDEVLHQLNFERFKNAGLTETVTWESNHGKNKHSKEQIIDWSKRVDHRHHAIDALVVACTQQGFIQRINTLNADETKDLMKRQIETVGVKYDEKKILLDKYLTSLAPFKTQTVANAASNILVSFKPGKK

SEQ ID NO: 3047 - protein, 166 aa, Unknown
  Description of Unknown: uncultivated organism with predicted taxonomy: Bacteroides
  MG16-145 RuvC-III domain
RETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKR

SEQ ID NO: 3048 - protein, 162 aa, Unknown
  Description of Unknown: uncultivated organism with predicted taxonomy: Bacteroidetes
  MG16-146 RuvC-III domain
RQSQYISKKAVEMLKQVCRNVWTTSGSVTDFVRHHWGYDNIIHDLNFQRNKNAGQTAIITYEHRGQTHQEERIKEWSKRLDHRHHAIDALTIASTKQSYIQRLNHLNTSRDAMFQELEAQSEEFKEKYSLLERWIKERPHIPVSEVTEAVDGILVSFKAGKR

SEQ ID NO: 3049 - protein, 163 aa, Unknown
  Description of Unknown: uncultivated organism with predicted taxonomy: Bacteroidales
  MG16-147 RuvC-III domain
RQSQYIAVKAVEVLQDGIRHVWTSGGSVTDFLRHQWGYDEILHTLNLPRYRQVEGLTEYVEFEHAGQKHTEERIKNWSKRIDHRHHAIDALTVALTQQGYIQRLNTLEASHDLMEKQVKEAGTHYNEKKSILEKWINEQPHFSVEDVTNVVKGILVSFRAGKR

SEQ ID NO: 3050 - protein, 163 aa, Unknown
  Description of Unknown: uncultivated organism with predicted taxonomy: Bacteroidales
  MG16-148 RuvC-III domain
RQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEDVTNAVDGILVSFRAGKR

SEQ ID NO: 3051 - protein, 166 aa, Unknown
  Description of Unknown: uncultivated organism with predicted taxonomy: Bacteroidetes
  MG16-149 RuvC-III domain
GETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKK

SEQ ID NO: 3052 - protein, 159 aa, Unknown
  Description of Unknown: uncultivated organism with predicted taxonomy: Bacteroidales
  MG16-150 RuvC-III domain
RLSQYISRKAMEILRMGCREVVATSGSITELIRHTWGYDTILHELNCPDYKEAGLTEIIIDEKTKRQREVISDWTKRLDHRHHAIDALAVACTTHSIVQHINTLHASRKIMRDEIKTSRKEWKDNYLLQQWIKEKMPFDRHYVLHKIASILVSMKAGKK

SEQ ID NO: 3053 - protein, 166 aa, Unknown; identical to SEQ ID NO: 3047
  Description of Unknown: uncultivated organism with predicted taxonomy: Prevotella
  MG16-151 RuvC-III domain

SEQ ID NO: 3054 - protein, 162 aa, Unknown
  Description of Unknown: uncultivated organism with predicted taxonomy: Fibrobacter
  MG16-152 RuvC-III domain
RQTQYISKKALEMLKEVCRNVYATSGSVTDFIRHTWGYDEILHQLNFDRYKQGGLTEAREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKR

SEQ ID NO: 3055 - protein, 163 aa, Unknown
  Description of Unknown: uncultivated organism with predicted taxonomy: Bacteroidales
  MG16-153 RuvC-III domain
RQSQYIAVKAVEILQQGIRQVWTSGGSVTDFLRHQWGYDEILHTLNLPRYRQVEDLTEMVHYEHAGQEHDEERIKNWSKRIDHRHHAIDALTVALTRQAYIQRLNTLEASHDFMEKQVKEAGTQYNEKKSILEKWILEQPHFSVDDVTQSVDSILVSFRAGKR

SEQ ID NO: 3056 - protein, 163 aa, Unknown
  Description of Unknown: uncultivated organism with predicted taxonomy: Bacteroidales
  MG16-154 RuvC-III domain
RQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKR

SEQ ID NO: 3057 - protein, 162 aa, Unknown
  Description of Unknown: uncultivated organism with predicted taxonomy: Bacteroidales
  MG16-155 RuvC-III domain
RQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKR

SEQ ID NO: 3058 - protein, 163 aa, Unknown; identical to SEQ ID NO: 3044
  Description of Unknown: uncultivated organism with predicted taxonomy: Bacteroidales
  MG16-156 RuvC-III domain

SEQ ID NO: 3059 - protein, 162 aa, Unknown
  Description of Unknown: uncultivated organism with predicted taxonomy: Fibrobacter
  MG16-157 RuvC-III domain
RQTQYIAKKALEMLKEVCYNVYATSGSVTDFIRHTWGYDEILHQLNFDRYKKGGLTELREFDHKGATHTEERIQNWSKRLDHRHHAIDALVIAMTRQSIIQRLNHLNTERDAMFQEVEKQSKEWKNDYSLLQEWLRERKHFSTDEVAQKVSDILASFKAGKR

SEQ ID NO: 3060 - protein, 162 aa, Unknown
  Description of Unknown: uncultivated organism with predicted taxonomy: Bacteroidetes
  MG16-158 RuvC-III domain
RQSQYISRKAVDMLKLVCRNVWTTSGSVTDFLRHNWGYDQILHDLNLPRYKEGGMTEVVHYEHNGQEHDEERIIGWTKRMDHRHHAIDALTIACTRQSYIQRLNTLNASRDAMHAEIEKQNAYWQEKHSLLEEWTRQRPHLPVSVVRDYVDGILVSFKPGKK

SEQ ID NO: 3061 - protein, 163 aa, Unknown
  Description of Unknown: uncultivated organism with predicted taxonomy: Bacteroidetes
  MG16-159 RuvC-III domain
RQSQYIARKSVEMLQQVCKNVYSTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTR

SEQ ID NO: 3062 - protein, 162 aa, Unknown
  Description of Unknown: uncultivated organism with predicted taxonomy: Fibrobacter
  MG16-160 RuvC-III domain
RQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKR

SEQ ID NO: 3063 - protein, 163 aa, Unknown
  Description of Unknown: uncultivated organism with predicted taxonomy: Bacteroidales
  MG16-161 RuvC-III domain
RQSQYIAVKAVEILQQGIRKVWTSGGSVTDFLRHQWGYDEVLHTLNLPRYHKVEGMTEFVQYEHAGQTHEEERIKNWTKRVDHRHHAIDALTVALTRQAYIQRLNTLEASHDLMEKQVKDAGTLYNEKKSILEKWINEQPHFSVDEVTRQVDGILISFRAGKR

SEQ ID NO: 3064 - protein, 163 aa, Unknown
  Description of Unknown: uncultivated organism with predicted taxonomy: Prevotella
  MG16-162 RuvC-III domain
RQSQYIARKAIEMLQQICKNVYSTSGRVTDFVRHQWGYDEILHDLNFDRYKKAGLTTMVTQLQSGDEVEVERIKDWTKRLDNRHHAVDALAIACTTQGMIQRLNTLNASRDEMQAELNDKNGSIMDPNRSMLEKWVSIQPHITYAEAKNEVDKIIISQRPNTR

SEQ ID NO: 3065 - protein, 166 aa, Unknown; identical to SEQ ID NO: 3047
  Description of Unknown: uncultivated organism with predicted taxonomy: Bacteroides
  MG16-163 RuvC-III domain

SEQ ID NO: 3066 - protein, 163 aa, Unknown
  Description of Unknown: uncultivated organism with predicted taxonomy: Prevotella
  MG16-164 RuvC-III domain
RQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTR

SEQ ID NO: 3067 - protein, 165 aa, Unknown
  Description of Unknown: uncultivated organism
  MG16-165 RuvC-III domain
RQSQYIAVKAVEILQQGIRQVWTSGGSVTDFLRHQWGYDEILHTLNLPRYRQVEDLTEIVHYEHAGQEHDEERIKNWSKRIDHRHHAIDALTVALTRQAYIKRLNSLNAEFTREEMLKEVEEANTVYNEKKSLLEKWILEQPHFSVDDVTNSVDSILVSFRAGKR

SEQ ID NO: 3068 - protein, 162 aa, Unknown
  Description of Unknown: uncultivated organism with predicted taxonomy: Bacteroidales
  MG16-166 RuvC-III domain
RLSQYIAKKSVEMLQQICRNVYVTSGSVTDFVRHQWGYDELLHDLNFERYKKAGLTAMVKQLHSGKEVEVERIKDWTKRLDNRHHAVDALAIACTTQGMIQRLNTLNASRDDMLEELNSKKRVADPNRSMLEKWLYAQPHVSYALAKEELDKIIVSQRPNTR

SEQ ID NO: 3069 - protein, 165 aa, Unknown
  Description of Unknown: uncultivated organism with predicted taxonomy: Bacteroidales
  MG16-167 RuvC-III domain
RLSQYIAVKAVDLLQQGIRQVWASSGTVTFFMRHQWGYDEILHTLNLPRYRRVEGMTEFVDFEHAGQKHTEERIKNWSKRIDHRHHAIDALTIALTRQAYIQSLNTLSSEITREEMIEIIKETGKVYKEKTSLLDKWARELPHFSVEDVTNAVDGILVSFRAGKR

SEQ ID NO: 3070 - protein, 159 aa, Unknown
  Description of Unknown: uncultivated organism with predicted taxonomy: Barnesiella viscericola
  MG16-168 RuvC-III domain
RLSQYISRKAQELLRTACRDVIATSGSITDLIRHTWGYDTILHELNFDCYKKAGLTEFIKDEKTGKNREVIQDWTKRLDHRHHAIDALAVACTSRSIIQRINTLHASREDIRKEIKSTRKEWQENDLLQQWIKEKMPFDRKYVLHKVASILVSMKAGKK

SEQ ID NO: 3071 - protein, 163 aa, Unknown; identical to SEQ ID NO: 3044
  Description of Unknown: uncultivated organism with predicted taxonomy: Bacteroidales
  MG16-169 RuvC-III domain

SEQ ID NO: 3072 - protein, 162 aa, Unknown; identical to SEQ ID NO: 3040
  Description of Unknown: uncultivated organism
  MG16-170 RuvC-III domain

SEQ ID NO: 3073 - protein, 163 aa, Unknown; identical to SEQ ID NO: 3063
  Description of Unknown: uncultivated organism with predicted taxonomy: Bacteroidales
  MG16-171 RuvC-III domain

SEQ ID NO: 3074 - protein, 118 aa, Unknown
  Description of Unknown: uncultivated organism with predicted taxonomy: Prevotella brevis
  MG16-172 RuvC-III domain
RQSQYIAVKAVEILQQAIRQVWTSGGSVTDFLRHQWGYDEILHTLNLPRYRQVEDLTEIVHYEHAGQEHEEERIKNWSKRIDHRHHAIDALTVALTRQAYIQRLNSLNAEFTREEMLK

SEQ ID NO: 3075 - protein, 166 aa, Unknown; identical to SEQ ID NO: 3047
  Description of Unknown: uncultivated organism with predicted taxonomy: Bacteroides
  MG16-173 RuvC-III domain

SEQ ID NO: 3076 - protein, 163 aa, Unknown
  Description of Unknown: uncultivated organism with predicted taxonomy: Bacteroidetes
  MG16-174 RuvC-III domain
RQSQYIAVKAVEVLQDGIRQVWTSGGSVTDFLRHQWGYDEILHTLNLPRYRQVEGLTEFVDYEHAGQKHTEERIKNWTKRIDHRHHAIDALTVALTQQGYIQRLNTLEASHDFMEKQVKETGTHYNEKKSILEKWINEQPHFSVEDVTSAVDGILVSFRAGKR

SEQ ID NO: 3077 - protein, 159 aa, Unknown
  Description of Unknown: uncultivated organism with predicted taxonomy: Prevotella
  MG16-175 RuvC-III domain
RLSQYISRKAQELLRTACRDVIATSGSITDLIRHTWGYDTILHELNFDCYKKAGLTEFIKDEKTGKIREVIQDWTKRLDHRHHAIDALAVACTSRSIIQRINTLHASREDIRKEIKSTRKEWQENDLLQQWIKEKMPFDRKYVLHKVASILVSMKAGKK

SEQ ID NO: 3078 - protein, 163 aa, Unknown; identical to SEQ ID NO: 3056
  Description of Unknown: uncultivated organism with predicted taxonomy: Bacteroidales
  MG16-176 RuvC-III domain

SEQ ID NO: 3079 - protein, 163 aa, Unknown; identical to SEQ ID NO: 3055
  Description of Unknown: uncultivated organism with predicted taxonomy: Bacteroidia
  MG16-177 RuvC-III domain

SEQ ID NO: 3080 - protein, 163 aa, Unknown; identical to SEQ ID NO: 3044
  Description of Unknown: uncultivated organism with predicted taxonomy: Porphyromonas sp. oral taxon 278
  MG16-178 RuvC-III domain

SEQ ID NO: 3081 - protein, 162 aa, Unknown; identical to SEQ ID NO: 3040
  Description of Unknown: uncultivated organism
  MG16-179 RuvC-III domain

SEQ ID NO: 3082 - protein, 165 aa, Unknown
  Description of Unknown: uncultivated organism with predicted taxonomy: Bacteroidales
  MG16-180 RuvC-III domain
RQSQYIAVKAVEILQQGIRQVWTSGGSVTDCLRHQWGYDEILHTLNLPRYRQVEDLTEIVHYEHAGQEHDEERIKNWSKRIDHRHHAIDALTVALTRQAYITRLNSLNAEFTREEMLKEVEEANTVYNEKKSLLEKWVNEQPHFSVEDVTQSVDGILVSFRAGKR

SEQ ID NO: 3083 - protein, 163 aa, Unknown; identical to SEQ ID NO: 3044
  Description of Unknown: uncultivated organism with predicted taxonomy: Bacteroidales
  MG16-181 RuvC-III domain

SEQ ID NO: 3084 - protein, 163 aa, Unknown
  Description of Unknown: uncultivated organism with predicted taxonomy: Prevotella
  MG16-182 RuvC-III domain
RQSQYIARKSVEMLQQICKNVYFTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTR

SEQ ID NO: 3085 - protein, 43 aa, Unknown
  Description of Unknown: uncultivated organism with predicted taxonomy: Prevotella
  MG16-183 RuvC-III domain
RLSPYIARKSVEMLQQICKNVYSTSGSVTDFVRHQWGYDEILH

SEQ ID NO: 3086 - protein, 163 aa, Unknown
  Description of Unknown: uncultivated organism with predicted taxonomy: Bacteroidales
  MG16-184 RuvC-III domain
RQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKETGTQYNEKKSILEKWVAEQPHFPVADVTENVDGILVSFRAGKR

SEQ ID NO: 3087 - protein, 162 aa, Unknown; identical to SEQ ID NO: 3062
  Description of Unknown: uncultivated organism with predicted taxonomy: Fibrobacter
  MG16-185 RuvC-III domain

SEQ ID NO: 3088 - protein, 163 aa, Unknown; identical to SEQ ID NO: 3066
  Description of Unknown: uncultivated organism with predicted taxonomy: Prevotella
  MG16-186 RuvC-III domain

SEQ ID NO: 3089 - protein, 163 aa, Unknown
  Description of Unknown: uncultivated organism with predicted taxonomy: Bacteroidales
  MG16-187 RuvC-III domain
RQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKR

SEQ ID NO: 3090 - protein, 163 aa, Unknown
  Description of Unknown: uncultivated organism
  MG16-188 RuvC-III domain
RQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3091 - protein, 163 aa, Unknown; identical to SEQ ID NO: 3090
  Description of Unknown: uncultivated organism
  MG16-189 RuvC-III domain

SEQ ID NO: 3092 - protein, 163 aa, Unknown
  Description of Unknown: uncultivated organism with predicted taxonomy: Prevotella ruminicola
  MG16-190 RuvC-III domain
RQSQYIAKKSVEMLQQVCKNVYTTSGSVTDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTR

SEQ ID NO: 3093 - protein, 163 aa, Unknown; identical to SEQ ID NO: 3089
  Description of Unknown: uncultivated organism with predicted taxonomy: Labilibaculum filiforme
  MG16-191 RuvC-III domain

SEQ ID NO: 3094 - protein, 163 aa, Unknown
  Description of Unknown: uncultivated organism with predicted taxonomy: Bacteroidales
  MG16-192 RuvC-III domain
RQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3095 - protein, 162 aa, Unknown
  Description of Unknown: uncultivated organism
  MG16-193 RuvC-III domain
RQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKR

SEQ ID NO: 3096 - protein, 47 aa, Unknown
  Description of Unknown: uncultivated organism with predicted taxonomy: Sediminibacterium sp. C3
  MG16-194 RuvC-III domain
RLSQYIAKKSVEMLQQVCRNVYSTSGSVTDFVRHQWGYDELLHDLNF

SEQ ID NO: 3097 - protein, 161 aa, Unknown
  Description of Unknown: uncultivated organism with predicted taxonomy: Bacteroides
  MG16-195 RuvC-III domain
RLSQYISKKAMEILSFGCRDVVATSGSITAIIRHAWGWDTILEELNIQTYRNANLTEVIEVKSKGQNKKMETIKNWTKRLDNRHHAIDALVVACTSSSIIQRINTLNASKQKMRDEITSARKKWDENNILTQWIREKNPLNRKEVLEHVSSIFISMKAGKK

SEQ ID NO: 3098 - protein, 163 aa, Unknown; identical to SEQ ID NO: 3094
  Description of Unknown: uncultivated organism with predicted taxonomy: Gammaproteobacteria bacterium
  MG16-196 RuvC-III domain

SEQ ID NO: 3099 - protein, 159 aa, Unknown
  Description of Unknown: uncultivated organism with predicted taxonomy: Bacteroides
  MG16-197 RuvC-III domain
RLSQYISKKAQEILKTACREVVATSGTITDLIRHTWGYDTILHELNFPNYKEAGLTSFVTDEKTNQQREVIKDWSKRLDHRHHAVDALAVACTSRSIVQHINTLHASRDEMRKEVNSARKDWKDNNLLQQWIMEKKPFDRQYVLHKVASILVSMKAGKR

SEQ ID NO: 3100 - protein, 105 aa, Unknown
  Description of Unknown: uncultivated organism with predicted taxonomy: Bacteroidales
  MG16-198 RuvC-III domain
RQSQYIAKKSVDMLQQVCKNVYTTSGSVTDFVRHQWGYDELLHELNFERFKKAGLTAMVKQLHSGKEIEVERIKDWTKRLDNRHHAVDALAIACTTQGMIQRLNT

SEQ ID NO: 3101 - protein, 163 aa, Unknown
  Description of Unknown: uncultivated organism with predicted taxonomy: Gammaproteobacteria bacterium
  MG16-199 RuvC-III domain
RQSQYIAKKSVDMLQQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3102 - protein, 162 aa, Unknown
  Description of Unknown: uncultivated organism with predicted taxonomy: Fibrobacter
  MG16-200 RuvC-III domain
RQTQYIAKKALEMLKDVCYNVYATSGSVTDFIRHTWGYDEILHQLNFDRYKKGGLTELREYDHKGETHTEERIQDWSKRLDHRHHAIDALVIAMTRQSIIQRLNHLNTERDAMFQEVEKQSKEWKNDYSMLQEWLRERKHFSTEDVAKKVSDILVSFKAGKR

SEQ ID NO: 3103 - protein, 166 aa, Unknown
  Description of Unknown: uncultivated organism with predicted taxonomy: Prevotella
  MG16-201 RuvC-III domain
GETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKK

SEQ ID NO: 3104 - protein, 163 aa, Unknown
  Description of Unknown: uncultivated organism
  MG16-202 RuvC-III domain
RQSQYIAKKAVEILKDGIREVWTSGGSVTDFLRHQWGYDEILHTLNLPRYQQVEGLTETIQYEHAGQTHEEERIKNWTKRIDHRHHAIDALTVALTQQAYIQRLNTLEASHDHMQKVVNEAGTQYNEKKSLLEKWVAEQPHFSVADVTDKVDGILVSFRAGKR

SEQ ID NO: 3105 - protein, 159 aa, Unknown
  Description of Unknown: uncultivated organism with predicted taxonomy: Bacteroides sp. CAG:144
  MG16-203 RuvC-III domain
RLSQYITKKAHELLRTACRDVLATSGSITDLTRHVWGYDTILHELNLPRYKSAGITEVITDERTGREQEVIRDWNKRLDHRHHAIDALAVACTSRSMIQRINTLHASREEMREEVSSPRKDWKENDLLRQWIKEQRPFERQYVLHKVESILVSMKAGKK

SEQ ID NO: 3106 - protein, 163 aa, Unknown
  Description of Unknown: uncultivated organism with predicted taxonomy: Bacteroidales
  MG16-204 RuvC-III domain
RQSQYIAKKSVEMLQLVCKNVYTTSGSVTDFVRHQWGYDELLHELNFERFKKAGLTAMVKQMHSGKEIEVERIKDWTKRLDNRHHAVDALAIACTTQGMIQRLNTLNASREEMLEELSINDQRLIDPERSMLEKWLFVQPHISYAEAKNEINKIVISQRPNTR

SEQ ID NO: 3107 - protein, 162 aa, Unknown; identical to SEQ ID NO: 3102
  Description of Unknown: uncultivated organism with predicted taxonomy: Fibrobacter
  MG16-205 RuvC-III domain

SEQ ID NO: 3108 - protein, 163 aa, Unknown
  Description of Unknown: uncultivated organism with predicted taxonomy: Gammaproteobacteria bacterium
  MG16-206 RuvC-III domain
RQSQYIAKKSVEILQQVCKDVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTR

SEQ ID NO: 3109 - protein, 159 aa, Unknown
  Description of Unknown: uncultivated organism
  MG16-207 RuvC-III domain
RLSQYITKKAHELLRTACRDVLATSGSITDLTRHVWGYDTILHELNLPRYKSAGITEVITDERTGREQEVIKDWNKRLDHRHHAIDALAVACTSRSMIQRINTLHASREEMREEVSSPRRDWKENDLLRQWIKEQLPFERQYVLHKVESILVSMKAGKK

SEQ ID NO: 3110 - protein, 163 aa, Unknown
  Description of Unknown: uncultivated organism
  MG16-208 RuvC-III domain
RQSQMIARKSFEVLRQICHNVYATSGSVTDFLRHQWGYDNILHDLNFERFSKSDNIEEITIVGRDGIETKVKRIKGWNKRIDNRHHAVDALTIALTTQSMIQRLNTLYASRDAMHGDIEASKQKFNEKKSILEKWTAIQPHFTYSQASEAISRILISQRGGKR

SEQ ID NO: 3111 - protein, 166 aa, Unknown; identical to SEQ ID NO: 3103
  Description of Unknown: uncultivated organism with predicted taxonomy: Chryseobacterium vrystaatense
  MG16-209 RuvC-III domain

SEQ ID NO: 3112 - protein, 162 aa, Unknown
  Description of Unknown: uncultivated organism
  MG16-210 RuvC-III domain
RQSQYISKKAIEMLKQICRYVWATSGSVTDFIRHNWGYDKILHDLNFERYKSGGLTEMVHYDHQGQEHDEERIKEWTKRLDHRHHALDALTIASTQQGYIQRLNHLNTERDQMFAELEMQREEYKGRYSLLEEWIKERPHISVEDAKVAVDQIAVSFKAGKK

SEQ ID NO: 3113 - protein, 166 aa, Unknown
  Description of Unknown: uncultivated organism with predicted taxonomy: Prevotella
  MG16-211 RuvC-III domain
GETQYISRESIRILKQCCRTVNATSGKITAILRHLWGYDEILHQLNFERYKKAGLTETKTWESNHGKNKHSKEQIVDWSKRIDHRHHAIDALVVACTQQGVIQRINTLNADETKDLMKKQIESANIKYEEKKVLLDKYLTSLVPFNTKTVAEAVNKILVSFKAGKK

SEQ ID NO: 3114 - protein, 163 aa, Unknown; identical to SEQ ID NO: 3064
  Description of Unknown: uncultivated organism with predicted taxonomy: Prevotella ihumii
  MG16-212 RuvC-III domain

SEQ ID NO: 3115 - protein, 162 aa, Unknown
  Description of Unknown: uncultivated organism with predicted taxonomy: Treponema pedis
  MG16-213 RuvC-III domain
RQSQYISKKAVEMLKQVCRYVWTTSGSVTDFLRQTWGYNNILHDLNFERYKSGGLTEIRQYDHKGQEQSKECIIGWTKRLDHRHHALDALTIASTQQGYIQRLNHLNTERDEMFAELKKQSEEHKEKHSLLEDWMKERPHLSVEAVKEAVDQIAVSFKAGKK

SEQ ID NO: 3116 - protein, 163 aa, Unknown
  Description of Unknown: uncultivated organism with predicted taxonomy: Sediminibacterium sp. C3
  MG16-214 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWIVVQPHISYSEAKNEIDKIVISQRPNTR

SEQ ID NO: 3117 - protein, 163 aa, Unknown
  Description of Unknown: uncultivated organism with predicted taxonomy: Prevotella
  MG16-215 RuvC-III domain
RQSQYIAKKSVEMLQQVCKNVYTTSGSVTDFVRHQWGYDDLLHDLNFERFKKAGLTAMVKQLHSGKEVEMERIKDWTKRLDNRHHAVDALAIACTTQGMIQRLNTLNASRDEILEELNSKDQRVVDPERSMLEKWVYAQPHISYAEAKNEIDKIVISQRPNTR

SEQ ID NO: 3118 - protein, 163 aa, Unknown
  Description of Unknown: uncultivated organism with predicted taxonomy: Bacteroidales
  MG16-216 RuvC-III domain
RQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTR

SEQ ID NO: 3119 - protein, 163 aa, Unknown
  Description of Unknown: uncultivated organism with predicted taxonomy: Porphyromonas catoniae
  MG16-217 RuvC-III domain
RQSQYIAKKSVEMLQQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3120 - protein, 163 aa, Unknown
  Description of Unknown: uncultivated organism with predicted taxonomy: Prevotella
  MG16-218 RuvC-III domain
RQSQYIAKKSVEMLQQVCKNVYTTSGSITDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTR

SEQ ID NO: 3121 - protein, 162 aa, Unknown
  Description of Unknown: uncultivated organism with predicted taxonomy: Fibrobacter
  MG16-219 RuvC-III domain
RQTQYISKKALEMLKEVCCKVYATNGSVTDFIRHTWGYDEILHQLNFDRYKQGGLTEVREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKR

SEQ ID NO: 3122 - protein, 163 aa, Unknown
  Description of Unknown: uncultivated organism with predicted taxonomy: Sediminibacterium sp. C3
  MG16-220 RuvC-III domain
RQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLNACRNEMLDELNSKDERVIDPERSMLEKWINSQPHICYAQAKDEVDKIIVSQRPNTR

SEQ ID NO: 3123 - protein, 163 aa, Unknown
  Description of Unknown: uncultivated organism with predicted taxonomy: Sediminibacterium sp. C3
  MG16-221 RuvC-III domain
RQSQYIAKKSVEMLQQVCKNVYTTSGSVTDFVRHQWGYDEILHDLNFERFKKAGLTAMVKQLHSGKEVEVERIMDWTKRLDNRHHAVDALTIACTTQGMIQRLNTLNASRDEMLEELNSKDQRVVDPERSMLEKWIFVQPHISYVEAKNEIDKIVISQRPNTR

SEQ ID NO: 3124 - protein, 163 aa, Unknown
  Description of Unknown: uncultivated organism with predicted taxonomy: Prevotella sp. ne3005
  MG16-222 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWVFVQPHISYSEAKNEIDKIVISQRPNTR

SEQ ID NO: 3125 - protein, 163 aa, Unknown
  Description of Unknown: uncultivated organism with predicted taxonomy: Prevotella copri
  MG16-223 RuvC-III domain
RQSQYIAKKSVEILQQVCKNVYTTSGSVTDFVRHQWGYDEILHDLNFEHFKKANLTTMVKQLHSGKEVEVERIKDWTKRLDNRHHAVDALAIACTTQGMIQRLNTLNASRDAMLDELNNKEQRMIDSERSMLEKWIISQPHVSYAEAKKEIDKILISLRPNTR

SEQ ID NO: 3126 - protein, 135 aa, Unknown
  Description of Unknown: uncultivated organism with predicted taxonomy: Bacteroides sp. CAG:770
  MG16-224 RuvC-III domain
RQSQYIAKKSVEMLQQVCKNVYTTSGSVTDFVRHQWGYDELLHELNIERFKKAGLTAMVKQLHSGKEVEVERIKDWTKRLDNRHHAVDAFAIACTTQGMIQRLNTLNASRDEMFEELNTKDQRLIDPERSMLEKW

SEQ ID NO: 3127 - protein, 162 aa, Unknown
  Description of Unknown: uncultivated organism with predicted taxonomy: Bacteroidales
  MG16-225 RuvC-III domain
RQSQYISKKAVEILRSAIRDVYATSGSVTDFLRHIWGYDQILHNLNLPKYRDAELTEFVTYDHRGQEHQEERIKNWSKRIDHRHHAIDALTIALTRQGYIQRLNNLNASHDDIAEAVRKVNPLMEKKYSLLEKYIYIQPHFTVQEVTDKVDGILVSFRAGKK

SEQ ID NO: 3128 - protein, 20 aa, Unknown
  Description of Unknown: uncultivated organism
  MG16-226 RuvC-III domain
RLSQYIATKAVEILQQGIRQ

SEQ ID NO: 3129 - protein, 165 aa, Unknown
  Description of Unknown: uncultivated organism with predicted taxonomy: Bacteroidales
  MG16-228 RuvC-III domain
RQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKR

SEQ ID NO: 3130 - protein, 165 aa, Unknown; identical to SEQ ID NO: 3129
  Description of Unknown: uncultivated organism with predicted taxonomy: Bacteroidales
  MG16-229 RuvC-III domain

SEQ ID NO: 3131 - protein, 150 aa, Unknown
  Description of Unknown: uncultivated organism with predicted taxonomy: Bacteroides sp. CAG:545
  MG16-230 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEASDNVSRILVSFKAGKK

SEQ ID NO: 3132 - protein, 150 aa, Unknown
  Description of Unknown: uncultivated organism with predicted taxonomy: Bacteroides sp. CAG:770
  MG16-231 RuvC-III domain
VQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNILNAKTAIGEEQMSLDKWTLAQAHFSVADVADHVADILVSFKSGKR

SEQ ID NO: 3133 - protein, 150 aa, Unknown
  Description of Unknown: uncultivated organism with predicted taxonomy: Bacteroides sp. CAG:770
  MG16-232 RuvC-III domain
VQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLSQPHFSVQEVSDNVSRILVSFKAGKK

SEQ ID NO: 3134 - protein, 150 aa, Unknown; identical to SEQ ID NO: 2934
  Description of Unknown: uncultivated organism with predicted taxonomy: Bacteroides sp. CAG:545
  MG16-233 RuvC-III domain

SEQ ID NO: 3135 - protein, 150 aa, Unknown
  Description of Unknown: uncultivated organism with predicted taxonomy: Bacteroides sp. CAG:770
  MG16-234 RuvC-III domain
VQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKR

SEQ ID NO: 3136 - protein, 150 aa, Unknown; identical to SEQ ID NO: 3135
  Description of Unknown: uncultivated organism with predicted taxonomy: Bacteroides sp. CAG:770
  MG16-235 RuvC-III domain

SEQ ID NO: 3137 - protein, 150 aa, Unknown
  Description of Unknown: uncultivated organism with predicted taxonomy: Bacteroides sp. CAG:770
  MG16-236 RuvC-III domain
VQTQYISRKAMEILNQVCRNVYGSSGDVTASLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKK

SEQ ID NO: 3138 - protein, 150 aa, Unknown; identical to SEQ ID NO: 2925
  Description of Unknown: uncultivated organism with predicted taxonomy: Bacteroides sp. CAG:770
  MG16-237 RuvC-III domain

SEQ ID NO: 3139 - protein, 150 aa, Unknown; identical to SEQ ID NO: 2925
  Description of Unknown: uncultivated organism with predicted taxonomy: Bacteroides sp. CAG:545
  MG16-238 RuvC-III domain

SEQ ID NO: 3140 - protein, 150 aa, Unknown; identical to SEQ ID NO: 2939
  Description of Unknown: uncultivated organism with predicted taxonomy: Bacteroides sp. CAG:770
  MG16-239 RuvC-III domain

SEQ ID NO: 3141 - protein, 150 aa, Unknown; identical to SEQ ID NO: 2939
  Description of Unknown: uncultivated organism with predicted taxonomy: Bacteroides sp. CAG:709
  MG16-240 RuvC-III domain

SEQ ID NO: 3142 - protein, 150 aa, Unknown; identical to SEQ ID NO: 2939
  Description of Unknown: uncultivated organism with predicted taxonomy: Bacteroides sp. CAG:770
  MG16-242 RuvC-III domain

SEQ ID NO: 3143 - protein, 150 aa, Unknown; identical to SEQ ID NO: 2939
  Description of Unknown: uncultivated organism with predicted taxonomy: Bacteroides sp. CAG:709
  MG16-243 RuvC-III domain

SEQ ID NO: 3144 - protein, 163 aa, Unknown
  Description of Unknown: uncultivated organism with predicted taxonomy: Bacteroidales
  MG16-245 RuvC-III domain
RQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSILERWVADQPHFSVADVTNKVDGILVSFRAGKR

SEQ ID NO: 3145 - protein, 163 aa, Unknown
  Description of Unknown: uncultivated organism with predicted taxonomy: Bacteroides sp. CAG:770
  MG16-246 RuvC-III domain
RQSQYIARKSVEMLQQVCKDVYTTSGSVTDFVRHQWGYDEILHDLNFERFKKAGLTTMVTQLHSGKEVEVERIKDWTKRLDNRHHAVDALAIACTTQGMIQRLNTLNASREGILDELNSKEERVVDPERSMLEKWIYTQPHISYAQAKEAIDNIIISQRPNIR

SEQ ID NO: 3146 - protein, 163 aa, Unknown
  Description of Unknown: uncultivated organism with predicted taxonomy: Porphyromonas sp. oral taxon 278
  MG16-247 RuvC-III domain
RQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKR

SEQ ID NO: 3147 - protein, 163 aa, Unknown
  Description of Unknown: uncultivated organism with predicted taxonomy: Coprobacter sp.
  MG16-248 RuvC-III domain
RQSQYIAVKAVEILQAGIRHVWTSGGSVTDFLRHQWGYDEILHTLNLPRYRKVDELTEIVHFEHAGQEHEEERIKNWTKRIDHRHHAIDALTVALTQQSYIQRLNTLEASHDWMEKQVKEVNTPYNEKKSVLERWIADQPHFSVSDVTDKVDGILVSFRAGKR

SEQ ID NO: 3148 - protein, 162 aa, Unknown; identical to SEQ ID NO: 3057
  Description of Unknown: uncultivated organism with predicted taxonomy: Bacteroides sp. CAG:144
  MG16-249 RuvC-III domain

SEQ ID NO: 3149 - protein, 163 aa, Unknown
  Description of Unknown: uncultivated organism with predicted taxonomy: Sediminibacterium sp. C3
  MG16-250 RuvC-III domain
RQSQYIAKKSVEMLQQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDVMLEELSSNDQRLVDPERSMLEKWIYVQPHISYAEAKNEVDKIVISQRPNTR

SEQ ID NO: 3150 - protein, 159 aa, Unknown
  Description of Unknown: uncultivated organism with predicted taxonomy: Bacteroides sp. CAG:144
  MG16-251 RuvC-III domain
RLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKK

SEQ ID NO: 3151 - protein, 162 aa, Unknown
  Description of Unknown: uncultivated organism with predicted taxonomy: Bacteroidales
  MG16-252 RuvC-III domain
RQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKK

SEQ ID NO: 3152 - protein, 159 aa, Unknown
  Description of Unknown: uncultivated organism
  MG16-253 RuvC-III domain
RLSQYISKKAQELLKAACREVMATSGSITDLIRHTWGYDTILHELNFPRYKDAGLTEIIKDEETGMQREVIPDWSKRLDHRHHAIDALAVACTSRSIVQRINTLNASREIIREEIKTSRKEWEDNDLLQQWIKEKMPFDRQYVVQKVASILVSMKAGKK

SEQ ID NO: 3153 - protein, 163 aa, Unknown
  Description of Unknown: uncultivated organism with predicted taxonomy: Marinilabiliaceae
  MG16-254 RuvC-III domain
RQSQYIAVKAVEVLQDGIRQVWTSGGSVTDFLRHQWGYDEILHTLNLPRYRQVEGLTELVDFEHAGQKHTEERIKNWSKRIDHRHHAIDALTVALTQQGYIQRLNTLEASHDFMEKQVKEAGTKYNEKKSILEKWINEQPHFSVEEVTNAVDRILVSFRAGKR

SEQ ID NO: 3154 - protein, 163 aa, Unknown
  Description of Unknown: uncultivated organism with predicted taxonomy: Bacteroidetes
  MG16-255 RuvC-III domain
RLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKH

SEQ ID NO: 3155 - protein, 159 aa, Unknown; identical to SEQ ID NO: 3150
  Description of Unknown: uncultivated organism with predicted taxonomy: Bacteroides sp. CAG:144
  MG16-256 RuvC-III domain

SEQ ID NO: 3156 - protein, 165 aa, Unknown
  Description of Unknown: uncultivated organism with predicted taxonomy: Bacteroidia
  MG16-257 RuvC-III domain
RQSQYIAVKAVEILQQGIRQVWTSGGSVTDFLRHLWGYDEILHTLNLPRYRQVEELTEIVHYEHAGQEHDEERIKNWSKRIDHRHHAIDALTVALTRQAYIQRLNSLNAEFTREEMLKEVEEANTVYNEKKSLLEKWVNEQPHFSVDDVTQSVDSILVSFRAGKR

SEQ ID NO: 3157 - protein, 163 aa, Unknown; identical to SEQ ID NO: 3146
  Description of Unknown: uncultivated organism with predicted taxonomy: Bacteroidales
  MG16-258 RuvC-III domain

SEQ ID NO: 3158 - protein, 162 aa, Unknown
  Description of Unknown: uncultivated organism with predicted taxonomy: Prevotella saccharolytica
  MG16-259 RuvC-III domain
RQTQYIAKKALEMLKDVCYNVYATSGSVTDFIRHTWGYDEILHQLNYDRYKKGGLTEFREYDHKGETHTEERIQDWSKRLDHRHHAIDALVIAMTRQSIIQRLNHLNTERDAMFQEVEKQRKEWKNDYSMLQEWLRERKHFSAEDVAKKVSDILVSFKAGKR

SEQ ID NO: 3159 - protein, 163 aa, Unknown; identical to SEQ ID NO: 3154
  Description of Unknown: uncultivated organism with predicted taxonomy: Bacteroides sp. CAG:770
  MG16-260 RuvC-III domain

SEQ ID NO: 3160 - protein, 162 aa, Unknown
  Description of Unknown: uncultivated organism with predicted taxonomy: Bacteroidales
  MG16-261 RuvC-III domain
RQTQYISKKALELLREICHNVYATSGSVTDFIRHTWGYDEILHQLNFDRYKQSGLTEIREFDNKGEIHKEERIQKWNKRLDHRHHAIDALVIAMTKQSIIQRLNHLNTERDAMFQEVEKQSIEWKNDFSLLQEWLRERKHFSTKDVANRVANILISFKAGKR

SEQ ID NO: 3161 - protein, 120 aa, Unknown
  Description of Unknown: uncultivated organism with predicted taxonomy: Porphyromonas catoniae
  MG16-262 RuvC-III domain
RQSQYIAKKSVEMLLQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDEMLEELNGK

SEQ ID NO: 3162 - protein, 163 aa, Unknown
  Description of Unknown: uncultivated organism with predicted taxonomy: Sediminibacterium sp. C3
  MG16-263 RuvC-III domain
RLSQYIAKKSVEMLQQVCRNVYSTSGSVTDFVRHQWGYDELLHDLNFERYKRAGLTAMVTQLRSGKEVEVERIKDWTKRLDNRHHAVDALAIACTTQGMIQRLNTLNASREDILDELNKTEERNDDSERSMLEKWICSQPHISYAEAKDELDKIIISQRPSTR

SEQ ID NO: 3163 - protein, 166 aa, Unknown
  Description of Unknown: uncultivated organism
  MG16-264 RuvC-III domain
GETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKK

SEQ ID NO: 3164 - protein, 163 aa, Unknown
  Description of Unknown: uncultivated organism
  MG16-265 RuvC-III domain
RQSQYIAKKSVEMLQLVCRNVYTTSGSVTETVRRLWGYNELLHDLNFERFKKAGLTTMVTQLHSGEEIEVERIKDWTKRLDNRHHAVDALAIACTTQGMIQRLNTLNASRDDMLKELNSQEQRVVDPEHSMLEKWIYTQPHISYVQAKEAIEKIIISQRPNTR

SEQ ID NO: 3165 - protein, 162 aa, Unknown; identical to SEQ ID NO: 3095
  Description of Unknown: uncultivated organism with predicted taxonomy: Porphyromonas sp. oral taxon 278
  MG16-266 RuvC-III domain

SEQ ID NO: 3166 - protein, 163 aa, Unknown
  Description of Unknown: uncultivated organism
  MG16-267 RuvC-III domain
RQSQYIAKKSVEMLLQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTR

SEQ ID NO: 3167 - protein, 163 aa, Unknown
  Description of Unknown: uncultivated organism with predicted taxonomy: Prevotella
  MG16-268 RuvC-III domain
SLSQYISRKAMEILQTGCRKVYATSGSITDIERHLWGYDTILHELNFPRYKCAGLTTVIKEEYEEGIITEKEVITNWSKRKDNRHHAIDALVIACTTQDTIQRINTLHASRDELQKETSGNPVFYSEKSTLLERWIKGKQPIPRHEVLEQVKQIAISIKAGKK

SEQ ID NO: 3168 - protein, 163 aa, Unknown; identical to SEQ ID NO: 3118
  Description of Unknown: uncultivated organism with predicted taxonomy: Bacteroidales
  MG16-269 RuvC-III domain

SEQ ID NO: 3169 - protein, 163 aa, Unknown
  Description of Unknown: uncultivated organism with predicted taxonomy: Bacteroidales
  MG16-270 RuvC-III domain
RQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSVLERWVADQPHFSVADVTDKVDGILVSFRAGKR

SEQ ID NO: 3170 - protein, 164 aa, Unknown
  Description of Unknown: uncultivated organism with predicted taxonomy: Bacteroidales
  MG16-271 RuvC-III domain
RQSQYIAAKAVEILQTAIRDVHATSGSVTELLRHQWGYDEILHHLNLPRYNKADLTEIVQYDHAGQKHTVERIKNWNKRLDQRHHAVDALTIALTKQSYIQRLNTLNASRETIYNEVEQADAKLRNEEKRTLLENWVAIQPHFPVKDVEDKVAGILVSFRAGKR

SEQ ID NO: 3171 - protein, 163 aa, Unknown
  Description of Unknown: uncultivated organism with predicted taxonomy: Bacteroides sp. CAG:770
  MG16-272 RuvC-III domain
RQSQYIAKKSVEMLQQVCKNVYTTSGSVTDFVRHQWGYDELLHELNFERFKKAGLTAMVKQLHSGKEIEVERIKDWTKRLDNRHHAVDALAIACTTQGMIQRLNTLNASRDEMQEELSSKEQRLVDPERSMLEKWIFAQPHISYAEAKNEIDKIIISQRPNTR

SEQ ID NO: 3172 - protein, 163 aa, Unknown
  Description of Unknown: uncultivated organism with predicted taxonomy: Bacteroidetes
  MG16-273 RuvC-III domain
RLSQYIAKKSVEMLQQVCKNVYATSGSITDFVRHQWGYDELLHDLNFERFKKAGLTTMVKQLHSGEEVEVERIANWTKRLDNRHHAVDALAIACTTQSMIQRLNTLNASRDDMLEEQNSKDQRLVDPERSMLEKWVFIQPHITYADAKKEIDKIVISQRPNTR

SEQ ID NO: 3173 - protein, 159 aa, Unknown
  Description of Unknown: uncultivated organism with predicted taxonomy: Bacteroidales
  MG16-274 RuvC-III domain
RLSQYISKKAQELLKTACREVMATSGSITDLIRHTWGYDTILHELNFPRYKDAGLTEIIKDEETGMQRELIPDWSKRLDHRHHAIDALAVACTSRSIVQRINTLHASREIIRDEIKTSRKEWEDNDLLQQWIKEKMPFDRQYVVQKVASILVSMKAGKK

SEQ ID NO: 3174 - protein, 166 aa, Unknown; identical to SEQ ID NO: 3163
  Description of Unknown: uncultivated organism with predicted taxonomy: Bacteroidetes
  MG16-275 RuvC-III domain

SEQ ID NO: 3175 - protein, 134 aa, Unknown
  Description of Unknown: uncultivated organism with predicted taxonomy: Clostridiales
  MG18-1 RuvC-III domain
VETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGR

SEQ ID NO: 3176 - protein, 136 aa, Unknown
  Description of Unknown: uncultivated organism with predicted taxonomy: Phascolarctobacterium succinatutens
  MG18-3 RuvC-III domain
VETRQSTKAVATILKTAYKHSEVVYVKAGNVSDFRHQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGK

SEQ ID NO: 3177 - protein, 136 aa, Unknown
  Description of Unknown: uncultivated organism with predicted taxonomy: Phascolarctobacterium succinatutens
  MG18-4 RuvC-III domain
VETRQSTKAVATILKTAYKHSEIVYVKAGNVSDFRQKFEFVKCRDVNDLHHAKDAYLNIVVGNCYHVKFTDKPMDFIKKNQDNRSYSLKPEIFYKFSIKRDSEIAWVGGKDGTITTVTKTMHKNNILFTRQPVEGK

SEQ ID NO: 3178 - protein, 136 aa, Unknown
  Description of Unknown: uncultivated organism with predicted taxonomy: Phascolarctobacterium succinatutens
  MG18-5 RuvC-III domain
VETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGK

SEQ ID NO: 3179 - protein, 136 aa, Unknown
  Description of Unknown: uncultivated organism with predicted taxonomy: Phascolarctobacterium
  MG18-6 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGEDGTMAIVARTMHKNNILFTRQAVEGK

SEQ ID NO: 3180 - protein, 136 aa, Unknown
  Description of Unknown: uncultivated organism with predicted taxonomy: Acidaminococcales
  MG18-7 RuvC-III domain
VETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGK

SEQ ID NO: 3181 - protein, 136 aa, Unknown
  Description of Unknown: uncultivated organism
  MG18-8 RuvC-III domain
VETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGK

SEQ ID NO: 3182 - protein, 136 aa, Unknown
  Description of Unknown: uncultivated organism with predicted taxonomy: Phascolarctobacterium succinatutens
  MG18-9 RuvC-III domain
VETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3183 - protein, 136 aa, Unknown; identical to SEQ ID NO: 3182
  Description of Unknown: uncultivated organism with predicted taxonomy: Phascolarctobacterium
  MG18-10 RuvC-III domain

SEQ ID NO: 3184 - protein, 136 aa, Unknown
  Description of Unknown: uncultivated organism with predicted taxonomy: Phascolarctobacterium succinatutens
  MG18-11 RuvC-III domain
VETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3185 - protein, 136 aa, Unknown
  Description of Unknown: uncultivated organism with predicted taxonomy: Phascolarctobacterium succinatutens
  MG18-12 RuvC-III domain
VETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGK

SEQ ID NO: 3186 - protein, 136 aa, Unknown; identical to SEQ ID NO: 3177
  Description of Unknown: uncultivated organism with predicted taxonomy: Phascolarctobacterium succinatutens
  MG18-13 RuvC-III domain

SEQ ID NO: 3187 - protein, 136 aa, Unknown; identical to SEQ ID NO: 3182
  Description of Unknown: uncultivated organism with predicted taxonomy: Phascolarctobacterium
  MG18-14 RuvC-III domain

SEQ ID NO: 3188 - protein, 136 aa, Unknown
  Description of Unknown: uncultivated organism with predicted taxonomy: Phascolarctobacterium succinatutens
  MG18-15 RuvC-III domain
VETRQSTKAVAAILKTAYQNSEVVYVKAGNVSDFRQQFKFEKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3189 - protein, 136 aa, Unknown; identical to SEQ ID NO: 3185
  Description of Unknown: uncultivated organism with predicted taxonomy: Phascolarctobacterium succinatutens
  MG18-16 RuvC-III domain

SEQ ID NO: 3190 - protein, 136 aa, Unknown; identical to SEQ ID NO: 3182
  Description of Unknown: uncultivated organism with predicted taxonomy: Phascolarctobacterium
  MG18-17 RuvC-III domain

SEQ ID NO: 3191 - protein, 136 aa, Unknown; identical to SEQ ID NO: 3182
  Description of Unknown: uncultivated organism with predicted taxonomy: Phascolarctobacterium succinatutens
  MG18-18 RuvC-III domain

SEQ ID NO: 3192 - protein, 136 aa, Unknown; identical to SEQ ID NO: 3182
  Description of Unknown: uncultivated organism with predicted taxonomy: Phascolarctobacterium
  MG18-19 RuvC-III domain

SEQ ID NO: 3193 - protein, 136 aa, Unknown; identical to SEQ ID NO: 3182
  Description of Unknown: uncultivated organism with predicted taxonomy: Phascolarctobacterium
  MG18-20 RuvC-III domain

SEQ ID NO: 3194 - protein, 136 aa, Unknown; identical to SEQ ID NO: 3182
  Description of Unknown: uncultivated organism with predicted taxonomy: Phascolarctobacterium
  MG18-21 RuvC-III domain

SEQ ID NO: 3195 - protein, 136 aa, Unknown; identical to SEQ ID NO: 3177
  Description of Unknown: uncultivated organism with predicted taxonomy: Phascolarctobacterium
  MG18-22 RuvC-III domain

SEQ ID NO: 3196 - protein, 136 aa, Unknown
  Description of Unknown: uncultivated organism with predicted taxonomy: Phascolarctobacterium succinatutens
  MG18-23 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVVRTMHKNNILFTRQAVEGK

SEQ ID NO: 3197 - protein, 136 aa, Unknown
  Description of Unknown: uncultivated organism with predicted taxonomy: Phascolarctobacterium
  MG18-24 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3198 - protein, 136 aa, Unknown; identical to SEQ ID NO: 3182
  Description of Unknown: uncultivated organism with predicted taxonomy: Phascolarctobacterium succinatutens
  MG18-25 RuvC-III domain

SEQ ID NO: 3199 - protein, 136 aa, Unknown; identical to SEQ ID NO: 3182
  Description of Unknown: uncultivated organism with predicted taxonomy: Phascolarctobacterium succinatutens
  MG18-26 RuvC-III domain

SEQ ID NO: 3200 - protein, 136 aa, Unknown; identical to SEQ ID NO: 3197
  Description of Unknown: uncultivated organism with predicted taxonomy: Phascolarctobacterium succinatutens
  MG18-27 RuvC-III domain

SEQ ID NO: 3201 - protein, 136 aa, Unknown
  Description of Unknown: uncultivated organism with predicted taxonomy: Phascolarctobacterium
  MG18-28 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3202 - protein, 136 aa, Unknown; identical to SEQ ID NO: 3197
  Description of Unknown: uncultivated organism with predicted taxonomy: Phascolarctobacterium succinatutens
  MG18-29 RuvC-III domain

SEQ ID NO: 3203 - protein, 136 aa, Unknown
  Description of Unknown: uncultivated organism with predicted taxonomy: Phascolarctobacterium succinatutens
  MG18-30 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3204 - protein, 136 aa, Unknown; identical to SEQ ID NO: 3203
  Description of Unknown: uncultivated organism with predicted taxonomy: Phascolarctobacterium succinatutens
  MG18-31 RuvC-III domain

SEQ ID NO: 3205 - protein, 136 aa, Unknown
  Description of Unknown: uncultivated organism with predicted taxonomy: Phascolarctobacterium succinatutens
  MG18-32 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3206 - protein, 136 aa, Unknown; identical to SEQ ID NO: 3182
  Description of Unknown: uncultivated organism with predicted taxonomy: Phascolarctobacterium succinatutens
  MG18-33 RuvC-III domain

SEQ ID NO: 3207 - protein, 136 aa, Unknown; identical to SEQ ID NO: 3182
  Description of Unknown: uncultivated organism with predicted taxonomy: Phascolarctobacterium succinatutens
  MG18-34 RuvC-III domain

SEQ ID NO: 3208 - protein, 136 aa, Unknown; identical to SEQ ID NO: 3185
  Description of Unknown: uncultivated organism with predicted taxonomy: Phascolarctobacterium succinatutens
  MG18-35 RuvC-III domain

SEQ ID NO: 3209 - protein, 136 aa, Unknown; identical to SEQ ID NO: 3182
  Description of Unknown: uncultivated organism with predicted taxonomy: Phascolarctobacterium succinatutens
  MG18-36 RuvC-III domain

SEQ ID NO: 3210 - protein, 136 aa, Unknown; identical to SEQ ID NO: 3197
  Description of Unknown: uncultivated organism with predicted taxonomy: Phascolarctobacterium succinatutens
  MG18-37 RuvC-III domain

SEQ ID NO: 3211 - protein, 136 aa, Unknown; identical to SEQ ID NO: 3203
  Description of Unknown: uncultivated organism with predicted taxonomy: Phascolarctobacterium
  MG18-38 RuvC-III domain

SEQ ID NO: 3212 - protein, 136 aa, Unknown; identical to SEQ ID NO: 3205
  Description of Unknown: uncultivated organism with predicted taxonomy: Phascolarctobacterium
  MG18-39 RuvC-III domain

SEQ ID NO: 3213 - protein, 136 aa, Unknown
  Description of Unknown: uncultivated organism with predicted taxonomy: Phascolarctobacterium succinatutens
  MG18-40 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGK

SEQ ID NO: 3214 - protein, 136 aa, Unknown
  Description of Unknown: uncultivated organism with predicted taxonomy: Phascolarctobacterium succinatutens
  MG18-41 RuvC-III domain
VETRQSTKAVAAILKTAYQNSEVVYVKAGNVSDFRQQFKFVKCRDVNDLHHAKDAYLNIVVGNCYHVKFTAHPLNFITKNQDNRRYSLKPEIFYKFSIKRDGEIAWLGGEDGTMATVARTMHKNNILFTRQAVEGK

SEQ ID NO: 3215 - protein, 136 aa, Unknown; identical to SEQ ID NO: 3176
  Description of Unknown: uncultivated organism with predicted taxonomy: Phascolarctobacterium succinatutens
  MG18-42 RuvC-III domain

SEQ ID NO: 3216 - protein, 136 aa, Unknown; identical to SEQ ID NO: 3185
  Description of Unknown: uncultivated organism with predicted taxonomy: Phascolarctobacterium succinatutens
  MG18-43 RuvC-III domain

SEQ ID NO: 3217 - protein, 136 aa, Unknown; identical to SEQ ID NO: 3197
  Description of Unknown: uncultivated organism with predicted taxonomy: Phascolarctobacterium succinatutens
  MG18-44 RuvC-III domain

SEQ ID NO: 3218 - protein, 136 aa, Unknown; identical to SEQ ID NO: 3197
  Description of Unknown: uncultivated organism with predicted taxonomy: Phascolarctobacterium succinatutens
  MG18-45 RuvC-III domain

SEQ ID NO: 3219 - protein, 136 aa, Unknown
  Description of Unknown: uncultivated organism with predicted taxonomy: Phascolarctobacterium
  MG18-46 RuvC-III domain
VETRQSTKAVAAILKTAYQNSEVVYVKAGNVSDFRQQFKFVKCREVNDLHHAKDAYLNIVVGNCYHVKFTANHLNFITKNQDNRRYSLKPEIFYKFSIKRDGEIAWLGGEDGTMATVARTMHKNNILFTRQAVEGK

SEQ ID NO: 3220 - protein, 136 aa, Unknown; identical to SEQ ID NO: 3180
  Description of Unknown: uncultivated organism with predicted taxonomy: Phascolarctobacterium
  MG18-47 RuvC-III domain

SEQ ID NO: 3221 - protein, 136 aa, Unknown; identical to SEQ ID NO: 3197
  Description of Unknown: uncultivated organism with predicted taxonomy: Phascolarctobacterium succinatutens
  MG18-48 RuvC-III domain

SEQ ID NO: 3222 - protein, 136 aa, Unknown; identical to SEQ ID NO: 3197
  Description of Unknown: uncultivated organism with predicted taxonomy: Phascolarctobacterium succinatutens
  MG18-49 RuvC-III domain

SEQ ID NO: 3223 - protein, 136 aa, Unknown; identical to SEQ ID NO: 3182
  Description of Unknown: uncultivated organism with predicted taxonomy: Phascolarctobacterium succinatutens
  MG18-50 RuvC-III domain

SEQ ID NO: 3224 - protein, 136 aa, Unknown
  Description of Unknown: uncultivated organism with predicted taxonomy: Phascolarctobacterium succinatutens
  MG18-51 RuvC-III domain
VETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGK

SEQ ID NO: 3225 - protein, 136 aa, Unknown; identical to SEQ ID NO: 3197
  Description of Unknown: uncultivated organism with predicted taxonomy: Phascolarctobacterium succinatutens
  MG18-52 RuvC-III domain

SEQ ID NO: 3226 - protein, 136 aa, Unknown; identical to SEQ ID NO: 3203
  Description of Unknown: uncultivated organism with predicted taxonomy: Firmicutes
  MG18-53 RuvC-III domain

SEQ ID NO: 3227 - protein, 136 aa, Unknown
  Description of Unknown: uncultivated organism with predicted taxonomy: Phascolarctobacterium
  MG18-54 RuvC-III domain
VETRQSTKAVATILKTAYKHSEIVYVKAGNVSDFRQKFEFVKCRDVNDLHHAKNAYLNIVVGNCYYVKFTAKPLDFIKKNQDNRSYSLKPEIFYKFSIKRDSEIAWVGGKDGTITTVTKTIHKNNILFTRQPVEGK

SEQ ID NO: 3228 - protein, 136 aa, Unknown; identical to SEQ ID NO: 3197
  Description of Unknown: uncultivated organism with predicted taxonomy: Phascolarctobacterium
  MG18-55 RuvC-III domain

SEQ ID NO: 3229 - protein, 136 aa, Unknown; identical to SEQ ID NO: 3182
  Description of Unknown: uncultivated organism with predicted taxonomy: Phascolarctobacterium succinatutens
  MG18-56 RuvC-III domain

SEQ ID NO: 3230 - protein, 136 aa, Unknown; identical to SEQ ID NO: 3197
  Description of Unknown: uncultivated organism with predicted taxonomy: Phascolarctobacterium succinatutens
  MG18-57 RuvC-III domain

SEQ ID NO: 3231 - protein, 136 aa, Unknown
  Description of Unknown: uncultivated organism with predicted taxonomy: Phascolarctobacterium succinatutens
  MG18-58 RuvC-III domain
VETRQSTKAVAAILKTAYQNSEVVYVKAGNVSDFRQQFKFVKCREVNDLHHAKDAYLNIVVGNCHHVKFTANPLNFITKNQDNRRYSLKPEIFYKFSIKRDGEIAWLGGEDGTMATVARTMHKNNILFTRQAVEGK

SEQ ID NO: 3232 - protein, 136 aa, Unknown; identical to SEQ ID NO: 3203
  Description of Unknown: uncultivated organism with predicted taxonomy: Phascolarctobacterium succinatutens
  MG18-59 RuvC-III domain

SEQ ID NO: 3233 - protein, 136 aa, Unknown; identical to SEQ ID NO: 3197
  Description of Unknown: uncultivated organism
  MG18-60 RuvC-III domain

SEQ ID NO: 3234 - protein, 136 aa, Unknown
  Description of Unknown: uncultivated organism with predicted taxonomy: Phascolarctobacterium succinatutens
  MG18-61 RuvC-III domain
VETRQSTKAVAAILKTAYQNSEVVYVKAGNVSDFRQQFKFVKCRELNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3235 - protein, 136 aa, Unknown; identical to SEQ ID NO: 3185
  Description of Unknown: uncultivated organism with predicted taxonomy: Phascolarctobacterium succinatutens
  MG18-62 RuvC-III domain

SEQ ID NO: 3236 - protein, 136 aa, Unknown; identical to SEQ ID NO: 3197
  Description of Unknown: uncultivated organism
  MG18-63 RuvC-III domain

SEQ ID NO: 3237 - protein, 136 aa, Unknown
  Description of Unknown: uncultivated organism with predicted taxonomy: Phascolarctobacterium succinatutens
  MG18-64 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGK

SEQ ID NO: 3238 - protein, 136 aa, Unknown; identical to SEQ ID NO: 3213
  Description of Unknown: uncultivated organism with predicted taxonomy: Firmicutes
  MG18-65 RuvC-III domain

SEQ ID NO: 3239 - protein, 136 aa, Unknown; identical to SEQ ID NO: 3197
  Description of Unknown: uncultivated organism with predicted taxonomy: Phascolarctobacterium succinatutens
  MG18-66 RuvC-III domain

SEQ ID NO: 3240 - protein, 136 aa, Unknown; identical to SEQ ID NO: 3184
  Description of Unknown: uncultivated organism
  MG18-67 RuvC-III domain

SEQ ID NO: 3241 - protein, 136 aa, Unknown; identical to SEQ ID NO: 3197
  Description of Unknown: uncultivated organism with predicted taxonomy: Phascolarctobacterium succinatutens
  MG18-68 RuvC-III domain

SEQ ID NO: 3242 - protein, 136 aa, Unknown; identical to SEQ ID NO: 3197
  Description of Unknown: uncultivated organism with predicted taxonomy: Phascolarctobacterium succinatutens
  MG18-69 RuvC-III domain

SEQ ID NO: 3243 - protein, 136 aa, Unknown; identical to SEQ ID NO: 3181
  Description of Unknown: uncultivated organism with predicted taxonomy: Negativicutes
  MG18-70 RuvC-III domain

SEQ ID NO: 3244 - protein, 136 aa, Unknown; identical to SEQ ID NO: 3197
  Description of Unknown: uncultivated organism with predicted taxonomy: Phascolarctobacterium succinatutens
  MG18-71 RuvC-III domain

SEQ ID NO: 3245 - protein, 136 aa, Unknown; identical to SEQ ID NO: 3213
  Description of Unknown: uncultivated organism with predicted taxonomy: Phascolarctobacterium succinatutens
  MG18-72 RuvC-III domain

SEQ ID NO: 3246 - protein, 136 aa, Unknown; identical to SEQ ID NO: 3224
  Description of Unknown: uncultivated organism with predicted taxonomy: Phascolarctobacterium
  MG18-73 RuvC-III domain

SEQ ID NO: 3247 - protein, 136 aa, Unknown
  Description of Unknown: uncultivated organism with predicted taxonomy: Phascolarctobacterium succinatutens
  MG18-74 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQAVEGK

SEQ ID NO: 3248 - protein, 136 aa, Unknown; identical to SEQ ID NO: 3179
  Description of Unknown: uncultivated organism with predicted taxonomy: Phascolarctobacterium
  MG18-75 RuvC-III domain

SEQ ID NO: 3249 - protein, 136 aa, Unknown; identical to SEQ ID NO: 3178
  Description of Unknown: uncultivated organism with predicted taxonomy: Phascolarctobacterium succinatutens
  MG18-76 RuvC-III domain

SEQ ID NO: 3250 - protein, 136 aa, Unknown; identical to SEQ ID NO: 3197
  Description of Unknown: uncultivated organism with predicted taxonomy: Phascolarctobacterium
  MG18-78 RuvC-III domain

SEQ ID NO: 3251 - protein, 136 aa, Unknown; identical to SEQ ID NO: 3197
  Description of Unknown: uncultivated organism with predicted taxonomy: Phascolarctobacterium succinatutens
  MG18-79 RuvC-III domain

SEQ ID NO: 3252 - protein, 136 aa, Unknown; identical to SEQ ID NO: 3196
  Description of Unknown: uncultivated organism with predicted taxonomy: Phascolarctobacterium succinatutens
  MG18-80 RuvC-III domain

SEQ ID NO: 3253 - protein, 136 aa, Unknown; identical to SEQ ID NO: 3180
  Description of Unknown: uncultivated organism with predicted taxonomy: Phascolarctobacterium succinatutens
  MG18-81 RuvC-III domain

SEQ ID NO: 3254 - protein, 136 aa, Unknown; identical to SEQ ID NO: 3185
  Description of Unknown: uncultivated organism with predicted taxonomy: Phascolarctobacterium succinatutens
  MG18-82 RuvC-III domain

SEQ ID NO: 3255 - protein, 136 aa, Unknown; identical to SEQ ID NO: 3201
  Description of Unknown: uncultivated organism with predicted taxonomy: Phascolarctobacterium succinatutens
  MG18-83 RuvC-III domain

SEQ ID NO: 3256 - protein, 136 aa, Unknown; identical to SEQ ID NO: 3185
  Description of Unknown: uncultivated organism with predicted taxonomy: Phascolarctobacterium succinatutens
  MG18-84 RuvC-III domain

SEQ ID NO: 3257 - protein, 136 aa, Unknown; identical to SEQ ID NO: 3197
  Description of Unknown: uncultivated organism with predicted taxonomy: Phascolarctobacterium
  MG18-85 RuvC-III domain

SEQ ID NO: 3258 - protein, 136 aa, Unknown; identical to SEQ ID NO: 3182
  Description of Unknown: uncultivated organism with predicted taxonomy: Phascolarctobacterium succinatutens
  MG18-86 RuvC-III domain

SEQ ID NO: 3259 - protein, 136 aa, Unknown; identical to SEQ ID NO: 3197
  Description of Unknown: uncultivated organism with predicted taxonomy: Phascolarctobacterium succinatutens
  MG18-87 RuvC-III domain

SEQ ID NO: 3260 - protein, 136 aa, Unknown; identical to SEQ ID NO: 3179
  Description of Unknown: uncultivated organism with predicted taxonomy: Phascolarctobacterium
  MG18-88 RuvC-III domain

SEQ ID NO: 3261 - protein, 136 aa, Unknown
  Description of Unknown: uncultivated organism with predicted taxonomy: Firmicutes
  MG18-89 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMETVARTMHKNNILFTRQAVEGK

SEQ ID NO: 3262 - protein, 136 aa, Unknown; identical to SEQ ID NO: 3205
  Description of Unknown: uncultivated organism with predicted taxonomy: Phascolarctobacterium
  MG18-90 RuvC-III domain

SEQ ID NO: 3263 - protein, 136 aa, Unknown
  Description of Unknown: uncultivated organism with predicted taxonomy: Phascolarctobacterium succinatutens
  MG18-91 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGADGTMATVARTMHKNNILFTRQPLEGK

SEQ ID NO: 3264 - protein, 136 aa, Unknown; identical to SEQ ID NO: 3197
  Description of Unknown: uncultivated organism with predicted taxonomy: Phascolarctobacterium succinatutens
  MG18-92 RuvC-III domain

SEQ ID NO: 3265 - protein, 136 aa, Unknown
  Description of Unknown: uncultivated organism
  MG18-93 RuvC-III domain
VEMRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGK

SEQ ID NO: 3266 - protein, 136 aa, Unknown; identical to SEQ ID NO: 3197
  Description of Unknown: uncultivated organism with predicted taxonomy: Phascolarctobacterium succinatutens
  MG18-94 RuvC-III domain

SEQ ID NO: 3267 - protein, 136 aa, Unknown; identical to SEQ ID NO: 3213
  Description of Unknown: uncultivated organism
  MG18-95 RuvC-III domain

SEQ ID NO: 3268 - protein, 136 aa, Unknown; identical to SEQ ID NO: 3197
  Description of Unknown: uncultivated organism with predicted taxonomy: Clostridium sp. CAG:964
  MG18-96 RuvC-III domain

SEQ ID NO: 3269 - protein, 136 aa, Unknown; identical to SEQ ID NO: 3197
  Description of Unknown: uncultivated organism with predicted taxonomy: Phascolarctobacterium succinatutens
  MG18-97 RuvC-III domain

SEQ ID NO: 3270 - protein, 136 aa, Unknown
  Description of Unknown: uncultivated organism with predicted taxonomy: Phascolarctobacterium succinatutens
  MG18-98 RuvC-III domain
VETRQSTKAVAAILKTAYQNSEVVYVKAGNVSDFRQQFNFVKCRDVNDLHHAKDAYLNIVVGNCYHVKFTANPLNFITKNQDNRRYSLKPEFFYKFNIKRDDDIAWLGGADGTMATVARTMHKNNILFTRQPLEGK

SEQ ID NO: 3271 - protein, 136 aa, Unknown; identical to SEQ ID NO: 3178
  Description of Unknown: uncultivated organism with predicted taxonomy: Firmicutes
  MG18-99 RuvC-III domain

SEQ ID NO: 3272 - protein, 136 aa, Unknown; identical to SEQ ID NO: 3197
  Description of Unknown: uncultivated organism with predicted taxonomy: Phascolarctobacterium succinatutens
  MG18-100 RuvC-III domain

SEQ ID NO: 3273 - protein, 136 aa, Unknown; identical to SEQ ID NO: 3203
  Description of Unknown: uncultivated organism with predicted taxonomy: Firmicutes
  MG18-101 RuvC-III domain

SEQ ID NO: 3274 - protein, 136 aa, Unknown; identical to SEQ ID NO: 3237
  Description of Unknown: uncultivated organism with predicted taxonomy: Firmicutes
  MG18-102 RuvC-III domain

SEQ ID NO: 3275 - protein, 136 aa, Unknown
  Description of Unknown: uncultivated organism with predicted taxonomy: Phascolarctobacterium succinatutens
  MG18-103 RuvC-III domain
VETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQAVEGK

SEQ ID NO: 3276 - protein, 136 aa, Unknown; identical to SEQ ID NO: 3197
  Description of Unknown: uncultivated organism with predicted taxonomy: Phascolarctobacterium
  MG18-104 RuvC-III domain

SEQ ID NO: 3277 - protein, 136 aa, Unknown; identical to SEQ ID NO: 3197
  Description of Unknown: uncultivated organism with predicted taxonomy: Phascolarctobacterium succinatutens
  MG18-105 RuvC-III domain

SEQ ID NO: 3278 - protein, 136 aa, Unknown; identical to SEQ ID NO: 3182
  Description of Unknown: uncultivated organism with predicted taxonomy: Firmicutes
  MG18-106 RuvC-III domain

SEQ ID NO: 3279 - protein, 136 aa, Unknown
  Description of Unknown: uncultivated organism with predicted taxonomy: Phascolarctobacterium succinatutens
  MG18-107 RuvC-III domain
VETRQSTKAVAAILKTAYQNSAVVYVKAGNVSDFRQQFKFVKCREVNDLHHAKDAYLNIVVGNCYHVKFTASPLNFITKNQDNRRYSLKPEIFYKFSIKRDGEIAWLGGEDGTMATVARTMHKNNILFTRQAVEGK

SEQ ID NO: 3280 - protein, 136 aa, Unknown; identical to SEQ ID NO: 3203
  Description of Unknown: uncultivated organism with predicted taxonomy: Ruminococcaceae bacterium
  MG18-108 RuvC-III domain

SEQ ID NO: 3281 - protein, 136 aa, Unknown; identical to SEQ ID NO: 3197
  Description of Unknown: uncultivated organism with predicted taxonomy: Phascolarctobacterium succinatutens
  MG18-109 RuvC-III domain

SEQ ID NO: 3282 - protein, 136 aa, Unknown; identical to SEQ ID NO: 3178
  Description of Unknown: uncultivated organism with predicted taxonomy: Phascolarctobacterium succinatutens
  MG18-111 RuvC-III domain

SEQ ID NO: 3283 - protein, 136 aa, Unknown; identical to SEQ ID NO: 3197
  Description of Unknown: uncultivated organism with predicted taxonomy: Phascolarctobacterium succinatutens
  MG18-112 RuvC-III domain

SEQ ID NO: 3284 - protein, 136 aa, Unknown
  Description of Unknown: uncultivated organism with predicted taxonomy: Clostridiales
  MG18-113 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGK

SEQ ID NO: 3285 - protein, 136 aa, Unknown
  Description of Unknown: uncultivated organism with predicted taxonomy: Phascolarctobacterium
  MG18-114 RuvC-III domain
VETRQSTKAVAAILKTAYQNSEVVYVKAGNVSDFRQQFKFVKCREVNDLHHAKDAYQNIVVGNCYHVKFTANPLNFITKNQDNRRYSLKPEIFYKFSIKRDGEIAWLGGEDGTMATVARTMHKNNILFTRQAVEGK

SEQ ID NO: 3286 - protein, 136 aa, Unknown; identical to SEQ ID NO: 3224
  Description of Unknown: uncultivated organism with predicted taxonomy: Phascolarctobacterium succinatutens
  MG18-115 RuvC-III domain

SEQ ID NO: 3287 - protein, 136 aa, Unknown
  Description of Unknown: uncultivated organism with predicted taxonomy: Phascolarctobacterium succinatutens
  MG18-116 RuvC-III domain
VETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFNIKRDDDIAWLGGEDGTMATVARTMHKNNILFTRQAVEGK

SEQ ID NO: 3288 - protein, 136 aa, Unknown; identical to SEQ ID NO: 3197
  Description of Unknown: uncultivated organism with predicted taxonomy: Phascolarctobacterium
  MG18-117 RuvC-III domain

SEQ ID NO: 3289 - protein, 136 aa, Unknown; identical to SEQ ID NO: 3197
  Description of Unknown: uncultivated organism with predicted taxonomy: Phascolarctobacterium succinatutens
  MG18-118 RuvC-III domain

SEQ ID NO: 3290 - protein, 136 aa, Unknown; identical to SEQ ID NO: 3197
  Description of Unknown: uncultivated organism with predicted taxonomy: Phascolarctobacterium succinatutens
  MG18-119 RuvC-III domain

SEQ ID NO: 3291 - protein, 136 aa, Unknown; identical to SEQ ID NO: 3197
  Description of Unknown: uncultivated organism with predicted taxonomy: Phascolarctobacterium succinatutens
  MG18-120 RuvC-III domain

SEQ ID NO: 3292 - protein, 136 aa, Unknown; identical to SEQ ID NO: 3224
  Description of Unknown: uncultivated organism with predicted taxonomy: Phascolarctobacterium succinatutens
  MG18-121 RuvC-III domain

SEQ ID NO: 3293 - protein, 136 aa, Unknown; identical to SEQ ID NO: 3203
  Description of Unknown: uncultivated organism with predicted taxonomy: Phascolarctobacterium
  MG18-122 RuvC-III domain

SEQ ID NO: 3294 - protein, 136 aa, Unknown; identical to SEQ ID NO: 3197
  Description of Unknown: uncultivated organism with predicted taxonomy: Phascolarctobacterium succinatutens
  MG18-123 RuvC-III domain

SEQ ID NO: 3295 - protein, 136 aa, Unknown; identical to SEQ ID NO: 3284
  Description of Unknown: uncultivated organism with predicted taxonomy: Phascolarctobacterium succinatutens
  MG18-124 RuvC-III domain

SEQ ID NO: 3296 - protein, 136 aa, Unknown; identical to SEQ ID NO: 3205
  Description of Unknown: uncultivated organism with predicted taxonomy: Phascolarctobacterium
  MG18-125 RuvC-III domain

SEQ ID NO: 3297 - protein, 136 aa, Unknown; identical to SEQ ID NO: 3284
  Description of Unknown: uncultivated organism with predicted taxonomy: Phascolarctobacterium
  MG18-126 RuvC-III domain

SEQ ID NO: 3298 - protein, 136 aa, Unknown; identical to SEQ ID NO: 3185
  Description of Unknown: uncultivated organism with predicted taxonomy: Phascolarctobacterium
  MG18-127 RuvC-III domain

SEQ ID NO: 3299 - protein, 136 aa, Unknown; identical to SEQ ID NO: 3197
  Description of Unknown: uncultivated organism with predicted taxonomy: Phascolarctobacterium
  MG18-128 RuvC-III domain

SEQ ID NO: 3300 - protein, 136 aa, Unknown; identical to SEQ ID NO: 3197
  Description of Unknown: uncultivated organism with predicted taxonomy: Phascolarctobacterium succinatutens
  MG18-129 RuvC-III domain

SEQ ID NO: 3301 - protein, 136 aa, Unknown; identical to SEQ ID NO: 3182
  Description of Unknown: uncultivated organism with predicted taxonomy: Phascolarctobacterium succinatutens
  MG18-130 RuvC-III domain

SEQ ID NO: 3302 - protein, 136 aa, Unknown; identical to SEQ ID NO: 3197
  Description of Unknown: uncultivated organism with predicted taxonomy: Phascolarctobacterium succinatutens
  MG18-131 RuvC-III domain

SEQ ID NO: 3303 - protein, 136 aa, Unknown; identical to SEQ ID NO: 3197
  Description of Unknown: uncultivated organism with predicted taxonomy: Phascolarctobacterium succinatutens
  MG18-132 RuvC-III domain

SEQ ID NO: 3304 - protein, 136 aa, Unknown; identical to SEQ ID NO: 3203
  Description of Unknown: uncultivated organism with predicted taxonomy: Phascolarctobacterium succinatutens
  MG18-133 RuvC-III domain

SEQ ID NO: 3305 - protein, 134 aa, Unknown; identical to SEQ ID NO: 3175
  Description of Unknown: uncultivated organism with predicted taxonomy: Clostridiales
  MG18-135 RuvC-III domain

SEQ ID NO: 3306 - protein, 134 aa, Unknown; identical to SEQ ID NO: 3175
  Description of Unknown: uncultivated organism with predicted taxonomy: Clostridiales
  MG18-136 RuvC-III domain

SEQ ID NO: 3307 - protein, 134 aa, Unknown; identical to SEQ ID NO: 3175
  Description of Unknown: uncultivated organism with predicted taxonomy: Dorea sp. OM02-2LB
  MG18-137 RuvC-III domain

SEQ ID NO: 3308 - protein, 136 aa, Unknown; identical to SEQ ID NO: 3197
  Description of Unknown: uncultivated organism with predicted taxonomy: Phascolarctobacterium
  MG18-138 RuvC-III domain

SEQ ID NO: 3309 - protein, 136 aa, Unknown; identical to SEQ ID NO: 3197
  Description of Unknown: uncultivated organism with predicted taxonomy: Phascolarctobacterium succinatutens
  MG18-139 RuvC-III domain

SEQ ID NO: 3310 - protein, 136 aa, Unknown; identical to SEQ ID NO: 3197
  Description of Unknown: uncultivated organism with predicted taxonomy: Phascolarctobacterium succinatutens
  MG18-140 RuvC-III domain

SEQ ID NO: 3311 - protein, 136 aa, Unknown; identical to SEQ ID NO: 3197
  Description of Unknown: uncultivated organism with predicted taxonomy: Firmicutes
  MG18-141 RuvC-III domain

SEQ ID NO: 3312 - protein, 136 aa, Unknown; identical to SEQ ID NO: 3197
  Description of Unknown: uncultivated organism with predicted taxonomy: Clostridium sp. CAG:964
  MG18-142 RuvC-III domain

SEQ ID NO: 3313 - protein, 134 aa, Unknown; identical to SEQ ID NO: 3175
  Description of Unknown: uncultivated organism with predicted taxonomy: Clostridiales
  MG18-143 RuvC-III domain

SEQ ID NO: 3314 - protein, 134 aa, Unknown; identical to SEQ ID NO: 3175
  Description of Unknown: uncultivated organism with predicted taxonomy: Firmicutes
  MG18-144 RuvC-III domain

SEQ ID NO: 3315 - protein, 134 aa, Unknown; identical to SEQ ID NO: 3175
  Description of Unknown: uncultivated organism with predicted taxonomy: Dorea sp. OM02-2LB
  MG18-145 RuvC-III domain

SEQ ID NO: 3316 - protein, 136 aa, Unknown; identical to SEQ ID NO: 3197
  Description of Unknown: uncultivated organism with predicted taxonomy: Phascolarctobacterium succinatutens
  MG18-146 RuvC-III domain

SEQ ID NO: 3317 - protein, 136 aa, Unknown; identical to SEQ ID NO: 3197
  Description of Unknown: uncultivated organism with predicted taxonomy: Firmicutes
  MG18-147 RuvC-III domain

SEQ ID NO: 3318 - protein, 136 aa, Unknown
  Description of Unknown: uncultivated organism with predicted taxonomy: Lactobacillus oryzae
  MG18-148 RuvC-III domain
VETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGKDGTITTVTKTMHKNNILFTRQPVEGK

SEQ ID NO: 3319 - protein, 136 aa, Unknown; identical to SEQ ID NO: 3203
  Description of Unknown: uncultivated organism with predicted taxonomy: Phascolarctobacterium
  MG18-149 RuvC-III domain

SEQ ID NO: 3320 - protein, 136 aa, Unknown; identical to SEQ ID NO: 3203
  Description of Unknown: uncultivated organism with predicted taxonomy: Firmicutes
  MG18-150 RuvC-III domain

SEQ ID NO: 3321 - protein, 136 aa, Unknown; identical to SEQ ID NO: 3224
  Description of Unknown: uncultivated organism with predicted taxonomy: Phascolarctobacterium
  MG18-151 RuvC-III domain

SEQ ID NO: 3322 - protein, 136 aa, Unknown; identical to SEQ ID NO: 3203
  Description of Unknown: uncultivated organism with predicted taxonomy: Phascolarctobacterium succinatutens
  MG18-152 RuvC-III domain

SEQ ID NO: 3323 - protein, 136 aa, Unknown; identical to SEQ ID NO: 3197
  Description of Unknown: uncultivated organism with predicted taxonomy: Firmicutes
  MG18-153 RuvC-III domain

SEQ ID NO: 3324 - protein, 136 aa, Unknown; identical to SEQ ID NO: 3197
  Description of Unknown: uncultivated organism with predicted taxonomy: Phascolarctobacterium succinatutens
  MG18-154 RuvC-III domain

SEQ ID NO: 3325 - protein, 136 aa, Unknown; identical to SEQ ID NO: 3182
  Description of Unknown: uncultivated organism with predicted taxonomy: Phascolarctobacterium succinatutens
  MG18-155 RuvC-III domain

SEQ ID NO: 3326 - protein, 136 aa, Unknown; identical to SEQ ID NO: 3197
  Description of Unknown: uncultivated organism with predicted taxonomy: Clostridium sp. CAG:964
  MG18-156 RuvC-III domain

SEQ ID NO: 3327 - protein, 136 aa, Unknown; identical to SEQ ID NO: 3224
  Description of Unknown: uncultivated organism with predicted taxonomy: Ruminococcaceae bacterium
  MG18-157 RuvC-III domain

SEQ ID NO: 3328 - protein, 136 aa, Unknown; identical to SEQ ID NO: 3182
  Description of Unknown: uncultivated organism with predicted taxonomy: Clostridium sp. CAG:964
  MG18-158 RuvC-III domain

SEQ ID NO: 3329 - protein, 136 aa, Unknown; identical to SEQ ID NO: 3205
  Description of Unknown: uncultivated organism with predicted taxonomy: Phascolarctobacterium succinatutens
  MG18-159 RuvC-III domain

SEQ ID NO: 3330 - protein, 137 aa, Unknown
  Description of Unknown: uncultivated organism with predicted taxonomy: Clostridiales
  MG18-160 RuvC-III domain
VETRQSTKAVAEILQQVYPLSKIVYVKAGLVADFRRYMGHVKCREVNDYHHAKDAYLNIVAGNIYHTRFTDNPYNFIKEAKDKDQKYSLKLEKLLTRDIRRGDITAWDTTGNKTRGVVEKVLARNDIRFTRYPYTEK

SEQ ID NO: 3331 - protein, 164 aa, Unknown
  Description of Unknown: uncultivated organism with predicted taxonomy: Firmicutes
  MG21-1 RuvC-III domain
QDTQYLSKVIFRLIENHLQFAETAPGKKHTQPVNGAITAQVRKRLGIEKIREDGDLHHAVDAAVIACITPGMIQKITKYAQNHERFYATAKGYVDIETGEVLTRSEYEAMDDIRFPEPWPGFRSELEARVSEHPQEAIARLKLPHYENSEEIRPIFVSRMPNHK

SEQ ID NO: 3332 - protein, 184 aa, Unknown
  Description of Unknown: uncultivated organism with predicted taxonomy: Roseburia sp. AM23-20
  MG21-3 RuvC-III domain
TDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRK

SEQ ID NO: 3333 - protein, 184 aa, Unknown; identical to SEQ ID NO: 3332
  Description of Unknown: uncultivated organism with predicted taxonomy: Clostridiales
  MG21-4 RuvC-III domain

SEQ ID NO: 3334 - protein, 184 aa, Unknown; identical to SEQ ID NO: 3332
  Description of Unknown: uncultivated organism
  MG21-5 RuvC-III domain

SEQ ID NO: 3335 - protein, 184 aa, Unknown; identical to SEQ ID NO: 3332
  Description of Unknown: uncultivated organism
  MG21-6 RuvC-III domain

SEQ ID NO: 3336 - protein, 168 aa, Unknown
  Description of Unknown: uncultivated organism with predicted taxonomy: Clostridium sp. CAG:571
  MG21-7 RuvC-III domain
NDTKYICKYMYNLIRNHLEFSDNANFVRKVWTVNGKLTAHIRKRLGIEKVRDGDTHHAVDATVIAITTQNMINRLTRYYQYVDGRYMNNKGEYIDTYTGEIINAKEYEEKYGIYFPEPWPKFRKELDIRTNCKTRERMIECLEAEKIYTYEDYDDVEPIFVSRMPRRK

SEQ ID NO: 3337 - protein, 167 aa, Unknown
  Description of Unknown: uncultivated organism with predicted taxonomy: Clostridiales
  MG21-8 RuvC-III domain
NDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHT

SEQ ID NO: 3338 - protein, 163 aa, Unknown
  Description of Unknown: uncultivated organism
  MG21-9 RuvC-III domain
TDTQYITKAVADILRNYLAFEEDSPFIKKPVRSINGAVTDQVRKRLGLQKHREEGDLHHAMDAAVIAVTTDGYINRISRYTQRREFGKRIGCYVDLETGEKLTKQAFEQKYEPTFPAPWNKFTKELKARMAPNADEAIRQLYLPSYGSEEIKPIFVSQMPDRK

SEQ ID NO: 3339 - protein, 168 aa, Unknown
  Description of Unknown: uncultivated organism with predicted taxonomy: Clostridiales
  MG21-10 RuvC-III domain
NDTKYICKYMYNLIRNHLEFSDNPNFVRKVWTVNGKLTAHIRKRLGIEKVRDGDTHHAVDATVIAITTQNMINRLTRYYQYVDGRYMNNKGEYIDIYTGEIINAKEYEEKNGIYFPEPWPKFRKELDIRTNCKTRERMIECLEAEKIYTYEDYDDVEPIFVSRMPRRK

SEQ ID NO: 3340 - protein, 168 aa, Unknown
  Description of Unknown: uncultivated organism with predicted taxonomy: Clostridiales
  MG21-11 RuvC-III domain
NDTKYICKYMYNLIRNHLEFSDNTNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECIEAERIYTYEDYNDVEPIFVSRMPRRK

SEQ ID NO: 3341 - protein, 184 aa, Unknown
  Description of Unknown: uncultivated organism with predicted taxonomy: Helicobacter sp. MIT 11-5569
  MG21-12 RuvC-III domain
TDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPDRK

SEQ ID NO: 3342 - protein, 168 aa, Unknown
  Description of Unknown: uncultivated organism with predicted taxonomy: Clostridium
  MG21-13 RuvC-III domain
QDTQYMCKLMYNLVRNHLEFSDNKNFERKVWTVNGSVTAHIRKRLGIEKTRDGDTHHAVDAAVIAITTQNMINRITKYYQYNDGKYMNNKGEYIDLETGEILDAKEYEAKNGIYFPEPWPKFRKELDIRVNCNSKERMIECLNAEKIFTYEDYEDVEPIFVSRMPRRK

SEQ ID NO: 3343 - protein, 191 aa, Unknown
  Description of Unknown: uncultivated organism with predicted taxonomy: Clostridiales
  MG21-14 RuvC-III domain
EDTQYISRLVYKLINNYMEFSDNPNVNRKVRNINGAVTHYIRNRLGIEKIRADGDEHHAVDACIIATTSNYMVNKITRYSQYIDGRFMNDRGEYIDIETGEIINKEEYEEEYGPKFPEPWEGFRRELEIRSSDDVANRAEKTPEELKNIMIQEINDEIKNGKLYSYIEHDDGINRFDDIEPIFVSRMPRRK

SEQ ID NO: 3344 - protein, 168 aa, Unknown
  Description of Unknown: uncultivated organism
  MG21-15 RuvC-III domain
QDTQYICKLMYNLVKNHLEFSNNKNFDRKVWTVNGAITSHIRKRLGIEKTRDGDIHHAIDAVVIAITTQEMINKLTKYYQYKDGKYMNNKGEFIDLETGEILDAEKYEKENGIYFPEPWPKFRKELEIRTICPTKETMISYLHNEKIFTYDDYEDVEPIFVSRMPKRK

SEQ ID NO: 3345 - protein, 184 aa, Unknown
  Description of Unknown: uncultivated organism
  MG21-16 RuvC-III domain
TDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPNRK

SEQ ID NO: 3346 - protein, 163 aa, Unknown
  Description of Unknown: uncultivated organism with predicted taxonomy: Clostridiales
  MG21-17 RuvC-III domain
KDTQYITRSIYNLLRDNLAFAESRYSKKPVQTVNGAVTSMLRSRWGVQKIREDGDLHHCMDAAVIAATSPGLVQRLTEYSKRREALEEAPRGYVDPSTGELVEQSEQPRRDPFPKPWEQFHQELEARLATVDPRHQIDLLKLATYESDEEVKPVFVSRMPNHK

SEQ ID NO: 3347 - protein, 163 aa, Unknown
  Description of Unknown: uncultivated organism with predicted taxonomy: Clostridiales bacterium 42_27
  MG21-18 RuvC-III domain
KDTQYITRSIYNLLRDNLAFAESRYSKKPVQTVNGAVTSMLRSRWGVQKIREDGDLHHCMDAAVIAATSPGLVQRLTEYSKQREAFVKAPAGYVDPSTGGLVEQSEASRRDPFPKPWEQFHQELEARLDPIDPQHQIDLLKLATYESDEEVKPVFVSRMPNHK

SEQ ID NO: 3348 - protein, 180 aa, Unknown
  Description of Unknown: uncultivated organism
  MG21-19 RuvC-III domain
VGVQNIQKRIADILRNYLRFYGEMPMEQHIVVTKNSITEAICEQLGLQRYYTKVSALSSALNAILIAVTPANYEAKVTQYVQSREEHYTDDGYIDPENGKKLTIEEFDAKYMPESDLKCIYSYLKEEIEIWMSSASDKKSINAKRGKLEKLHKKLGLKGKYENEINNWKPIFVSQMPDRK

SEQ ID NO: 3349 - protein, 163 aa, Unknown; identical to SEQ ID NO: 3346
  Description of Unknown: uncultivated organism with predicted taxonomy: Clostridiales
  MG21-20 RuvC-III domain

SEQ ID NO: 3350 - protein, 168 aa, Unknown
  Description of Unknown: uncultivated organism with predicted taxonomy: Clostridiales bacterium 42_27
  MG21-21 RuvC-III domain
NDTKYICKYMYNLIRNHLEFSDNPNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLEAEKVYTYEDYDDVEPIFVSRMPRRK

SEQ ID NO: 3351 - protein, 92 aa, Unknown
  Description of Unknown: uncultivated organism with predicted taxonomy: Clostridiales
  MG21-22 RuvC-III domain
KDTQYITRAVYNLIRDHLAFAESNYRKKPVQAVNGAVTAMLRGRWGVQKIREDGDLHHCLDAAVIAATTPGLVQCLTAYNKHRETWERPPAG

SEQ ID NO: 3352 - protein, 167 aa, Unknown
  Description of Unknown: uncultivated organism with predicted taxonomy: Roseburia inulinivorans
  MG21-23 RuvC-III domain
NDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHT

SEQ ID NO: 3353 - protein, 157 aa, Unknown
  Description of Unknown: uncultivated organism with predicted taxonomy: Firmicutes
  MG21-24 RuvC-III domain
NDTQHITRVVYNYLRNNLEFADSAYAKAPVQAVNGAVTAMLRGRWGIEKMRGDGDLHHCKDAVVIAATSRSMIEDLTKYYQEEEQRFMGKTHFVDPATGEVLTRKEFPQPWPRFREELEARLDPIDPMEAVMALHLSTYEPEEEIAPVFVSHMPKHT

SEQ ID NO: 3354 - protein, 163 aa, Unknown
  Description of Unknown: uncultivated organism with predicted taxonomy: Clostridiales bacterium 42_27
  MG21-25 RuvC-III domain
KDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARHDPFPKPWERFRQELEARLDPIDPRHQIDLLKLETYESDEEIKPVFVSRMPNHK

SEQ ID NO: 3355 - protein, 163 aa, Unknown
  Description of Unknown: uncultivated organism with predicted taxonomy: Ruminococcaceae bacterium TF06-43
  MG21-26 RuvC-III domain
KDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3356 - protein, 166 aa, Unknown
  Description of Unknown: uncultivated organism with predicted taxonomy: Clostridiales
  MG21-27 RuvC-III domain
VDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKQTHK

SEQ ID NO: 3357 - protein, 163 aa, Unknown
  Description of Unknown: uncultivated organism with predicted taxonomy: Clostridiales bacterium 42_27
  MG21-28 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHK

SEQ ID NO: 3358 - protein, 163 aa, Unknown
  Description of Unknown: uncultivated organism with predicted taxonomy: Firmicutes
  MG21-29 RuvC-III domain
KDTQYITRAIYTLIRDNLVFAESNYKKRPVQTVNGAVTSMLRNRWGVQKIREDGDLHHCLDAAVIAATTPGLVQRLTEHSKRRETLEKAPAGYVDPATGELIELPQEARRDPFPKPWERFRQELEARLDPIDPRHQIDLLKLETYESDEEIKPVFVSRMPNHK

SEQ ID NO: 3359 - protein, 163 aa, Unknown
  Description of Unknown: uncultivated organism with predicted taxonomy: Clostridiales bacterium 42_27
  MG21-30 RuvC-III domain
KDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3360 - protein, 159 aa, Unknown
  Description of Unknown: uncultivated organism
  MG21-31 RuvC-III domain
NDTQHITRVVYNYLRNNLEFADSAYAKAPVQAVNGAVTAMLRGRWGIEKMRGNGDLHHCKDAVVIAATSDSMIKDLTKYYQEEEQRFMGKTHFVDPATGEVLTRKEFPQPWPRFREELEARLDPTNPKEALMALNLSTYEFDPEEEIPPVFVSHMPKHT

SEQ ID NO: 3361 - protein, 163 aa, Unknown
  Description of Unknown: uncultivated organism with predicted taxonomy: Ruminococcaceae bacterium TF06-43
  MG21-32 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPASYVDPATGDLLELPQEARRDLFPKPWERFRQELEARLNPIDPRHQIDLLKLSTYESDEEIKPVFVSRMPNHK

SEQ ID NO: 3362 - protein, 166 aa, Unknown
  Description of Unknown: uncultivated organism with predicted taxonomy: Clostridiales
  MG21-33 RuvC-III domain
VDTQYIARVIYNLINDHLQFAETGKYDKKRRTQAVNGAITAHVRKRLGIQKIREDGDLHHAVDAAVVACVSPSMIQKITQYTKHRECIRKTKEGYLDTETGELMTREAYDAKYSPRFPAPWERFRQELEARLSDNPAEEIARLHLATYDSEEEIKPVFVSRKQTHK

SEQ ID NO: 3363 - protein, 163 aa, Unknown
  Description of Unknown: uncultivated organism with predicted taxonomy: Clostridiales
  MG21-34 RuvC-III domain
KDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHK

SEQ ID NO: 3364 - protein, 163 aa, Unknown
  Description of Unknown: uncultivated organism with predicted taxonomy: Clostridiales
  MG21-35 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3365 - protein, 168 aa, Unknown
  Description of Unknown: uncultivated organism
  MG21-36 RuvC-III domain
QDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRK

SEQ ID NO: 3366 - protein, 163 aa, Unknown
  Description of Unknown: uncultivated organism with predicted taxonomy: Clostridiales
  MG21-37 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHK

SEQ ID NO: 3367 - protein, 163 aa, Unknown; identical to SEQ ID NO: 3357
  Description of Unknown: uncultivated organism with predicted taxonomy: Clostridiales bacterium 42_27
  MG21-38 RuvC-III domain

SEQ ID NO: 3368 - protein, 163 aa, Unknown
  Description of Unknown: uncultivated organism with predicted taxonomy: Clostridiales
  MG21-39 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLNPIDPRHQIDLLKLSTYESDEEIKPVFVSRMPNHK

SEQ ID NO: 3369 - protein, 163 aa, Unknown
  Description of Unknown: uncultivated organism with predicted taxonomy: Clostridiales
  MG21-40 RuvC-III domain
KDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPQHQIDLLKLATYESDEEIRPVFVSRMPNHK

SEQ ID NO: 3370 - protein, 165 aa, Unknown
  Description of Unknown: uncultivated organism with predicted taxonomy: Firmicutes
  MG21-41 RuvC-III domain
NDTQHITRVVYNYLRNNLEFADSAYAKAPVQAVNGAVTAMLRGRWGIEKMRGDGDLHHCKDAVVIAATSRSMVQRLTNYYKEEERLFMGKTHFVDPATGEVLTRKEFQQRFAPKFPQPWDRFREELEARLDPIDPMEAVMALHLSTYEPEEEIAPVFVSHMPKHT

SEQ ID NO: 3371 - protein, 168 aa, Unknown
  Description of Unknown: uncultivated organism with predicted taxonomy: Clostridiales
  MG21-42 RuvC-III domain
NDTKYICKYMYNLIRNHLEFSDNANFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLESEKIYTYEDYDDVEPIFVSRMPRRK

SEQ ID NO: 3372 - protein, 163 aa, Unknown
  Description of Unknown: uncultivated organism with predicted taxonomy: Clostridiales bacterium 42_27
  MG21-43 RuvC-III domain
KDTQYITRAVYNLIRDHLAFAESNYRKKPVQAVNGAVTAMLRGRWGVQKIREDGDLHPCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHK

SEQ ID NO: 3373 - protein, 168 aa, Unknown
  Description of Unknown: uncultivated organism with predicted taxonomy: Clostridiales
  MG21-44 RuvC-III domain
QDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRK

SEQ ID NO: 3374 - protein, 163 aa, Unknown; identical to SEQ ID NO: 3359
  Description of Unknown: uncultivated organism with predicted taxonomy: Clostridiales
  MG21-45 RuvC-III domain

SEQ ID NO: 3375 - protein, 168 aa, Unknown; identical to SEQ ID NO: 3371
  Description of Unknown: uncultivated organism with predicted taxonomy: Clostridiales
  MG21-46 RuvC-III domain

SEQ ID NO: 3376 - protein, 166 aa, Unknown; identical to SEQ ID NO: 3356
  Description of Unknown: uncultivated organism with predicted taxonomy: Clostridiales
  MG21-47 RuvC-III domain

SEQ ID NO: 3377 - protein, 163 aa, Unknown; identical to SEQ ID NO: 3366
  Description of Unknown: uncultivated organism with predicted taxonomy: Clostridiales bacterium 42_27
  MG21-48 RuvC-III domain

SEQ ID NO: 3378 - protein, 163 aa, Unknown
  Description of Unknown: uncultivated organism with predicted taxonomy: Clostridiales bacterium 42_27
  MG21-49 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHK

SEQ ID NO: 3379 - protein, 163 aa, Unknown; identical to SEQ ID NO: 3357
  Description of Unknown: uncultivated organism with predicted taxonomy: Clostridiales bacterium 42_27
  MG21-50 RuvC-III domain

SEQ ID NO: 3380 - protein, 163 aa, Unknown
  Description of Unknown: uncultivated organism with predicted taxonomy: Clostridiales bacterium 42_27
  MG21-51 RuvC-III domain
KDTQYITRAVYNLIREHLVFAESAYRKKPVQTVNGAVTSMLRGRWGVQKIREDGDLHHCLDAAVIAATTPGLVQRLTAYNKRRESWERSPAGYVDPATGELIVLPQEARRDPFPKPWERFRQELEARLDPIDPRHQIDLLKLETYESDEEIKPVFVSRMPNHK

SEQ ID NO: 3381 - protein, 163 aa, Unknown
  Description of Unknown: uncultivated organism with predicted taxonomy: Clostridiales bacterium 42_27
  MG21-52 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIQPVFVSRMPNHK

SEQ ID NO: 3382 - protein, 166 aa, Unknown
  Description of Unknown: uncultivated organism with predicted taxonomy: Clostridiales
  MG21-53 RuvC-III domain
VDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKPERK

SEQ ID NO: 3383 - protein, 163 aa, Unknown
  Description of Unknown: uncultivated organism with predicted taxonomy: Clostridiales
  MG21-54 RuvC-III domain
KDTQYITRTVYNLIRDHLAFAESAYRKKPVQAVNGAVTAMLRGRWGVQKIREDGDLHHCLDAAVIAATTPGLVQRLTAYNKHRETWERPPAGYVDPVTGELIELPQEARRDPFPKPWERFRQELEARLDPIDPRHQIDLLKLETYESDEEIKPVFVSRMPNHK

SEQ ID NO: 3384 - protein, 165 aa, Unknown
  Description of Unknown: uncultivated organism with predicted taxonomy: Ruminococcaceae bacterium TF06-43
  MG21-55 RuvC-III domain
NDTQHITRVVYNFLRNNLEFADSAYAKAPVQAVNGAVTAMLRGRWGIEKMRGNGDLHHCKDAVVIAATSDSMIEDLTDYYKEEERLFMGKTHFVDPATGEALTRKEFQQRFAPQFPQPWPRFREELEARLDPIDPMEAVMALHLSTYEPDEEIAPVFVSHMPKHT

SEQ ID NO: 3385 - protein, 163 aa, Unknown
  Description of Unknown: uncultivated organism with predicted taxonomy: Clostridiales bacterium 42_27
  MG21-56 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDPLTAETYESDEEIKPVFVSRMPNHK

SEQ ID NO: 3386 - protein, 164 aa, Unknown
  Description of Unknown: uncultivated organism
  MG21-57 RuvC-III domain
QDTQYLSKVVFRLIEDHLQFAETAPGKKHTQPVNGAITAQVRKRLGIEKIREDGDLHHAMDAAVIACITPGMIQRITKYAQNHERFYATAKGYADIKTGEVLTRAQYEAMDDIRFPEPWAGFRLELEARVSDHPQEAIAQLKLPHYENSEEIRPIFVSRMPNHK

SEQ ID NO: 3387 - protein, 163 aa, Unknown
  Description of Unknown: uncultivated organism with predicted taxonomy: Oscillibacter sp. CAG:241_62_21
  MG21-58 RuvC-III domain
KDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHK

SEQ ID NO: 3388 - protein, 163 aa, Unknown; identical to SEQ ID NO: 3387
  Description of Unknown: uncultivated organism with predicted taxonomy: Clostridiales
  MG21-59 RuvC-III domain

SEQ ID NO: 3389 - protein, 163 aa, Unknown; identical to SEQ ID NO: 3357
  Description of Unknown: uncultivated organism with predicted taxonomy: Firmicutes
  MG21-60 RuvC-III domain

SEQ ID NO: 3390 - protein, 163 aa, Unknown; identical to SEQ ID NO: 3363
  Description of Unknown: uncultivated organism with predicted taxonomy: Clostridiales
  MG21-61 RuvC-III domain

SEQ ID NO: 3391 - protein, 163 aa, Unknown; identical to SEQ ID NO: 3366
  Description of Unknown: uncultivated organism with predicted taxonomy: Firmicutes bacterium CAG:129
  MG21-62 RuvC-III domain

SEQ ID NO: 3392 - protein, 163 aa, Unknown
  Description of Unknown: uncultivated organism with predicted taxonomy: Clostridiales
  MG21-63 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLELETYESDEEIKPVFASRMPNHK

SEQ ID NO: 3393 - protein, 163 aa, Unknown
  Description of Unknown: uncultivated organism with predicted taxonomy: Clostridiales
  MG21-64 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHK

SEQ ID NO: 3394 - protein, 160 aa, Unknown
  Description of Unknown: uncultivated organism with predicted taxonomy: Clostridiales bacterium 42_27
  MG21-65 RuvC-III domain
VDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVS

SEQ ID NO: 3395 - protein, 163 aa, Unknown; identical to SEQ ID NO: 3393
  Description of Unknown: uncultivated organism with predicted taxonomy: Clostridiales
  MG21-66 RuvC-III domain

SEQ ID NO: 3396 - protein, 163 aa, Unknown; identical to SEQ ID NO: 3358
  Description of Unknown: uncultivated organism with predicted taxonomy: Clostridia
  MG21-67 RuvC-III domain

SEQ ID NO: 3397 - protein, 163 aa, Unknown; identical to SEQ ID NO: 3378
  Description of Unknown: uncultivated organism with predicted taxonomy: Clostridiales
  MG21-68 RuvC-III domain

SEQ ID NO: 3398 - protein, 165 aa, Unknown
  Description of Unknown: uncultivated organism with predicted taxonomy: Firmicutes
  MG21-69 RuvC-III domain
NDTQHITRVVYNYLRNNLEFADSAYAKAPVRAVNGAVTAMLRGRWGIEKMRGNGDLHHCKDAVVIAATSRSMVQRLTNYYKEEERLFMGKTNFVDPATGEVLTRKEFQQRFAPKFPQPWDRFREELEARLDPIDPMEAVTALYLSTYEPEEEIAPVFVSHMPKHT

SEQ ID NO: 3399 - protein, 167 aa, Unknown
  Description of Unknown: uncultivated organism with predicted taxonomy: Firmicutes
  MG21-70 RuvC-III domain
NDTQHITRVVYNYLRNNLEFADSAYAKAPVRAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHT

SEQ ID NO: 3400 - protein, 157 aa, Unknown; identical to SEQ ID NO: 3353
  Description of Unknown: uncultivated organism with predicted taxonomy: Clostridiales
  MG21-71 RuvC-III domain

SEQ ID NO: 3401 - protein, 167 aa, Unknown; identical to SEQ ID NO: 3352
  Description of Unknown: uncultivated organism
  MG21-72 RuvC-III domain

SEQ ID NO: 3402 - protein, 163 aa, Unknown; identical to SEQ ID NO: 3393
  Description of Unknown: uncultivated organism with predicted taxonomy: Clostridiales
  MG21-73 RuvC-III domain

SEQ ID NO: 3403 - protein, 165 aa, Unknown
  Description of Unknown: uncultivated organism with predicted taxonomy: Firmicutes
  MG21-74 RuvC-III domain
NDTQHITRVVYNYLRNNLSFADSTYANAPVQAVSGTVTATLRGRWGIEKMREDGDLHHCKDAVVIAATSPSMIQRLSNYYKEEERLFMGKTHFVDPETGEVLTRKAFQQRFAPKFPQPWDRFREELEARLDPVNPMDAVMALHLSTYEPDEDITPVFVSHMPKHT

SEQ ID NO: 3404 - protein, 168 aa, Unknown
  Description of Unknown: uncultivated organism with predicted taxonomy: Clostridiales
  MG21-75 RuvC-III domain
CDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRK

SEQ ID NO: 3405 - protein, 163 aa, Unknown; identical to SEQ ID NO: 3378
  Description of Unknown: uncultivated organism with predicted taxonomy: Clostridiales bacterium 42_27
  MG21-76 RuvC-III domain

SEQ ID NO: 3406 - protein, 166 aa, Unknown
  Description of Unknown: uncultivated organism with predicted taxonomy: Clostridiales
  MG21-77 RuvC-III domain
VDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHK

SEQ ID NO: 3407 - protein, 163 aa, Unknown; identical to SEQ ID NO: 3378
  Description of Unknown: uncultivated organism with predicted taxonomy: Clostridiales bacterium 42_27
  MG21-78 RuvC-III domain

SEQ ID NO: 3408 - protein, 163 aa, Unknown
  Description of Unknown: uncultivated organism with predicted taxonomy: Clostridiales
  MG21-79 RuvC-III domain
KDTQYITRTVYNLIRNHLAFAESAYRKKPVQAVNGAVTAMLRGRWGVQKIREDSDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3409 - protein, 164 aa, Unknown
  Description of Unknown: uncultivated organism with predicted taxonomy: Clostridiales
  MG21-80 RuvC-III domain
QDTQYLSKVVFRLIEDHLQFAKTAPGKKHTQPVNGAITAQVRKRLGIEKIREDGDLHHAMDAAVIACITPGMIQRITKYAQNHERFYATAKGYVDIKTGEVLTRAQYEAMDDIRFPEPWAGFRLELEARVSDHPQEAIAQLKLPHYENSEEIRPIFVSRMPNHK

SEQ ID NO: 3410 - protein, 163 aa, Unknown
  Description of Unknown: uncultivated organism with predicted taxonomy: Clostridiales
  MG21-81 RuvC-III domain
KDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHK

SEQ ID NO: 3411 - protein, 163 aa, Unknown; identical to SEQ ID NO: 3378
  Description of Unknown: uncultivated organism with predicted taxonomy: Clostridiales bacterium 42_27
  MG21-82 RuvC-III domain

SEQ ID NO: 3412 - protein, 163 aa, Unknown; identical to SEQ ID NO: 3378
  Description of Unknown: uncultivated organism with predicted taxonomy: Clostridiales bacterium 42_27
  MG21-83 RuvC-III domain

SEQ ID NO: 3413 - protein, 163 aa, Unknown
  Description of Unknown: uncultivated organism with predicted taxonomy: Clostridiales
  MG21-84 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHK

SEQ ID NO: 3414 - protein, 166 aa, Unknown
  Description of Unknown: uncultivated organism with predicted taxonomy: Clostridiales
  MG21-85 RuvC-III domain
VDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYPPRFPAPWERFRQELEARLSDNPAEEIARLHLATYDSEEEIKPVFVSRKPERK

SEQ ID NO: 3415 - protein, 163 aa, Unknown; identical to SEQ ID NO: 3410
  Description of Unknown: uncultivated organism with predicted taxonomy: Firmicutes
  MG21-86 RuvC-III domain

SEQ ID NO: 3416 - protein, 163 aa, Unknown; identical to SEQ ID NO: 3363
  Description of Unknown: uncultivated organism with predicted taxonomy: Clostridiales
  MG21-87 RuvC-III domain

SEQ ID NO: 3417 - protein, 166 aa, Unknown
  Description of Unknown: uncultivated organism with predicted taxonomy: Clostridiales
  MG21-88 RuvC-III domain
VDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKPVFVSRKQTHK

SEQ ID NO: 3418 - protein, 163 aa, Unknown; identical to SEQ ID NO: 3363
  Description of Unknown: uncultivated organism with predicted taxonomy: Clostridiales
  MG21-89 RuvC-III domain

SEQ ID NO: 3419 - protein, 163 aa, Unknown; identical to SEQ ID NO: 3378
  Description of Unknown: uncultivated organism with predicted taxonomy: Clostridiales bacterium 42_27
  MG21-90 RuvC-III domain

SEQ ID NO: 3420 - protein, 163 aa, Unknown; identical to SEQ ID NO: 3378
  Description of Unknown: uncultivated organism with predicted taxonomy: Clostridiales bacterium 42_27
  MG21-91 RuvC-III domain

SEQ ID NO: 3421 - protein, 163 aa, Unknown
  Description of Unknown: uncultivated organism with predicted taxonomy: Ruminococcaceae bacterium TF06-43
  MG21-92 RuvC-III domain
KDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLNPIDPRHQIDLLKLETYESDEEIKPVFASRMPNHK

SEQ ID NO: 3422 - protein, 163 aa, Unknown; identical to SEQ ID NO: 3363
  Description of Unknown: uncultivated organism with predicted taxonomy: Ruminococcaceae bacterium TF06-43
  MG21-93 RuvC-III domain

SEQ ID NO: 3423 - protein, 163 aa, Unknown; identical to SEQ ID NO: 3413
  Description of Unknown: uncultivated organism with predicted taxonomy: Clostridiales
  MG21-94 RuvC-III domain

SEQ ID NO: 3424 - protein, 163 aa, Unknown; identical to SEQ ID NO: 3357
  Description of Unknown: uncultivated organism with predicted taxonomy: Clostridiales bacterium 42_27
  MG21-95 RuvC-III domain

SEQ ID NO: 3425 - protein, 163 aa, Unknown; identical to SEQ ID NO: 3378
  Description of Unknown: uncultivated organism with predicted taxonomy: Clostridiales bacterium 42_27
  MG21-96 RuvC-III domain

SEQ ID NO: 3426 - protein, 168 aa, Unknown
  Description of Unknown: uncultivated organism with predicted taxonomy: Clostridium
  MG21-97 RuvC-III domain
QDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAVKIYYENYDDVKPVFISRMPRRK

SEQ ID NO: 3427 - protein, 166 aa, Unknown
  Description of Unknown: uncultivated organism with predicted taxonomy: Clostridiales
  MG21-98 RuvC-III domain
VDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYSPRFPAPWERFRQELEARLSDNPAEEIARLHLATYDSEEEIKPVFVSRKPKRK

SEQ ID NO: 3428 - protein, 163 aa, Unknown; identical to SEQ ID NO: 3357
  Description of Unknown: uncultivated organism with predicted taxonomy: Clostridiales bacterium 42_27
  MG21-99 RuvC-III domain

SEQ ID NO: 3429 - protein, 163 aa, Unknown; identical to SEQ ID NO: 3363
  Description of Unknown: uncultivated organism with predicted taxonomy: Clostridiales
  MG21-100 RuvC-III domain

SEQ ID NO: 3430 - protein, 168 aa, Unknown
  Description of Unknown: uncultivated organism with predicted taxonomy: Clostridiales
  MG21-101 RuvC-III domain
QDTQYISRLMYNLIKNHVQFSNNENFERKVFTVNGQITSHIGKRLGINKIRENGDEHHATDAVIIATVSQGMIQRITKYYQYIDGRYEKNSGEYIDMETGEIITKEQYEAKNGSNFPEPWPKFRKELDIRTTCKTKARMEECLLTEKIFYDDYDDVKPIFISRMPKRK

SEQ ID NO: 3431 - protein, 168 aa, Unknown; identical to SEQ ID NO: 3373
  Description of Unknown: uncultivated organism with predicted taxonomy: Clostridium
  MG21-102 RuvC-III domain

SEQ ID NO: 3432 - protein, 163 aa, Unknown
  Description of Unknown: uncultivated organism with predicted taxonomy: Clostridiales
  MG21-103 RuvC-III domain
KDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHK

SEQ ID NO: 3433 - protein, 163 aa, Unknown; identical to SEQ ID NO: 3378
  Description of Unknown: uncultivated organism with predicted taxonomy: Clostridiales bacterium 42_27
  MG21-104 RuvC-III domain

SEQ ID NO: 3434 - protein, 163 aa, Unknown
  Description of Unknown: uncultivated organism with predicted taxonomy: Clostridiales bacterium 42_27
  MG21-105 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHK

SEQ ID NO: 3435 - protein, 109 aa, Unknown
  Description of Unknown: uncultivated organism with predicted taxonomy: Oscillibacter sp. CAG:241_62_21
  MG21-106 RuvC-III domain
KDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQ

SEQ ID NO: 3436 - protein, 168 aa, Unknown; identical to SEQ ID NO: 3373
  Description of Unknown: uncultivated organism with predicted taxonomy: Clostridium
  MG21-107 RuvC-III domain

SEQ ID NO: 3437 - protein, 163 aa, Unknown; identical to SEQ ID NO: 3363
  Description of Unknown: uncultivated organism with predicted taxonomy: Clostridiales
  MG21-108 RuvC-III domain

SEQ ID NO: 3438 - protein, 163 aa, Unknown; identical to SEQ ID NO: 3357
  Description of Unknown: uncultivated organism with predicted taxonomy: Clostridiales bacterium 42_27
  MG21-109 RuvC-III domain

SEQ ID NO: 3439 - protein, 163 aa, Unknown; identical to SEQ ID NO: 3387
  Description of Unknown: uncultivated organism with predicted taxonomy: Oscillibacter sp. CAG:241_62_21
  MG21-110 RuvC-III domain

SEQ ID NO: 3440 - protein, 163 aa, Unknown; identical to SEQ ID NO: 3432
  Description of Unknown: uncultivated organism with predicted taxonomy: Clostridiales
  MG21-111 RuvC-III domain

SEQ ID NO: 3441 - protein, 163 aa, Unknown; identical to SEQ ID NO: 3357
  Description of Unknown: uncultivated organism with predicted taxonomy: Clostridiales bacterium 42_27
  MG21-112 RuvC-III domain

SEQ ID NO: 3442 - protein, 163 aa, Unknown; identical to SEQ ID NO: 3378
  Description of Unknown: uncultivated organism with predicted taxonomy: Clostridiales bacterium 42_27
  MG21-113 RuvC-III domain

SEQ ID NO: 3443 - protein, 163 aa, Unknown
  Description of Unknown: uncultivated organism with predicted taxonomy: Clostridiales bacterium 42_27
  MG21-114 RuvC-III domain
KDTQYITRAVYNLIRDHLTFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHK

SEQ ID NO: 3444 - protein, 166 aa, Unknown; identical to SEQ ID NO: 3406
  Description of Unknown: uncultivated organism with predicted taxonomy: Clostridiales
  MG21-115 RuvC-III domain

SEQ ID NO: 3445 - protein, 163 aa, Unknown; identical to SEQ ID NO: 3363
  Description of Unknown: uncultivated organism with predicted taxonomy: Clostridiales
  MG21-116 RuvC-III domain

SEQ ID NO: 3446 - protein, 163 aa, Unknown; identical to SEQ ID NO: 3357
  Description of Unknown: uncultivated organism with predicted taxonomy: Clostridiales bacterium 42_27
  MG21-117 RuvC-III domain

SEQ ID NO: 3447 - protein, 163 aa, Unknown; identical to SEQ ID NO: 3359
  Description of Unknown: uncultivated organism with predicted taxonomy: Clostridiales bacterium 42_27
  MG21-118 RuvC-III domain

SEQ ID NO: 3448 - protein, 163 aa, Unknown; identical to SEQ ID NO: 3378
  Description of Unknown: uncultivated organism with predicted taxonomy: Clostridiales bacterium 42_27
  MG21-119 RuvC-III domain

SEQ ID NO: 3449 - protein, 163 aa, Unknown; identical to SEQ ID NO: 3363
  Description of Unknown: uncultivated organism with predicted taxonomy: Ruminococcaceae bacterium TF06-43
  MG21-120 RuvC-III domain

SEQ ID NO: 3450 - protein, 163 aa, Unknown; identical to SEQ ID NO: 3432
  Description of Unknown: uncultivated organism with predicted taxonomy: Clostridiales
  MG21-121 RuvC-III domain

SEQ ID NO: 3451 - protein, 165 aa, Unknown; identical to SEQ ID NO: 3398
  Description of Unknown: uncultivated organism
  MG21-122 RuvC-III domain

SEQ ID NO: 3452 - protein, 163 aa, Unknown; identical to SEQ ID NO: 3357
  Description of Unknown: uncultivated organism with predicted taxonomy: Clostridiales
  MG21-123 RuvC-III domain

SEQ ID NO: 3453 - protein, 163 aa, Unknown; identical to SEQ ID NO: 3357
  Description of Unknown: uncultivated organism with predicted taxonomy: Clostridiales bacterium 42_27
  MG21-124 RuvC-III domain

SEQ ID NO: 3454 - protein, 163 aa, Unknown; identical to SEQ ID NO: 3357
  Description of Unknown: uncultivated organism with predicted taxonomy: Clostridiales bacterium 42_27
  MG21-125 RuvC-III domain

SEQ ID NO: 3455 - protein, 95 aa, Unknown
  Description of Unknown: uncultivated organism with predicted taxonomy: Clostridiales bacterium 42_27
  MG21-126 RuvC-III domain
KDTQYITRAVYNLIRDHLAFAESNYRKKPVQAVNGAVAAMLRGRWGVQKIREDGDLHHCLDAAVIAATTPGLVQRLTAYNKHRETWERSPAGYVD

SEQ ID NO: 3456 - protein, 163 aa, Unknown
  Description of Unknown: uncultivated organism with predicted taxonomy: Clostridiales bacterium 42_27
  MG21-127 RuvC-III domain
KDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLNPIDPRHQIDLLKLETYESDEEIKPVFVSRMPNHK

SEQ ID NO: 3457 - protein, 163 aa, Unknown; identical to SEQ ID NO: 3378
  Description of Unknown: uncultivated organism with predicted taxonomy: Clostridiales bacterium 42_27
  MG21-128 RuvC-III domain

SEQ ID NO: 3458 - protein, 163 aa, Unknown; identical to SEQ ID NO: 3434
  Description of Unknown: uncultivated organism with predicted taxonomy: Clostridiales bacterium 42_27
  MG21-129 RuvC-III domain

SEQ ID NO: 3459 - protein, 163 aa, Unknown; identical to SEQ ID NO: 3378
  Description of Unknown: uncultivated organism with predicted taxonomy: Clostridiales bacterium 42_27
  MG21-130 RuvC-III domain

SEQ ID NO: 3460 - protein, 163 aa, Unknown; identical to SEQ ID NO: 3378
  Description of Unknown: uncultivated organism with predicted taxonomy: Clostridiales bacterium 42_27
  MG21-131 RuvC-III domain

SEQ ID NO: 3461 - protein, 163 aa, Unknown; identical to SEQ ID NO: 3378
  Description of Unknown: uncultivated organism with predicted taxonomy: Clostridiales bacterium 42_27
  MG21-132 RuvC-III domain

SEQ ID NO: 3462 - protein, 163 aa, Unknown; identical to SEQ ID NO: 3387
  Description of Unknown: uncultivated organism with predicted taxonomy: Clostridiales
  MG21-133 RuvC-III domain

SEQ ID NO: 3463 - protein, 163 aa, Unknown; identical to SEQ ID NO: 3378
  Description of Unknown: uncultivated organism with predicted taxonomy: Clostridiales bacterium 42_27
  MG21-134 RuvC-III domain

SEQ ID NO: 3464 - protein, 163 aa, Unknown; identical to SEQ ID NO: 3357
  Description of Unknown: uncultivated organism with predicted taxonomy: Clostridiales
  MG21-135 RuvC-III domain

SEQ ID NO: 3465 - protein, 167 aa, Unknown; identical to SEQ ID NO: 3337
  Description of Unknown: uncultivated organism with predicted taxonomy: Clostridiales
  MG21-136 RuvC-III domain

SEQ ID NO: 3466 - protein, 168 aa, Unknown
  Description of Unknown: uncultivated organism with predicted taxonomy: Clostridiales
  MG21-137 RuvC-III domain
QDTQYISRLMYNLIKDHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRK

SEQ ID NO: 3467 - protein, 163 aa, Unknown; identical to SEQ ID NO: 3357
  Description of Unknown: uncultivated organism with predicted taxonomy: Clostridiales bacterium 42_27
  MG21-138 RuvC-III domain

SEQ ID NO: 3468 - protein, 163 aa, Unknown; identical to SEQ ID NO: 3357
  Description of Unknown: uncultivated organism with predicted taxonomy: Clostridiales
  MG21-139 RuvC-III domain

SEQ ID NO: 3469 - protein, 163 aa, Unknown; identical to SEQ ID NO: 3378
  Description of Unknown: uncultivated organism with predicted taxonomy: Clostridiales bacterium 42_27
  MG21-140 RuvC-III domain

SEQ ID NO: 3470 - protein, 165 aa, Unknown
  Description of Unknown: uncultivated organism with predicted taxonomy: Firmicutes
  MG21-141 RuvC-III domain
NDTQHITRVVYNYLRNNLEFADSAYAKAPVQAVNGAVTAMLRGRWGIEKMRGDGDLHHCKDAVVIAATSPSMIQRLSNYYKEEERLFMGKTHFVDPGTGEVLTRKEFQQRFAPQFPQPWPRFREELEARLDPVNPTEALMALHLSTYEPEEEIKPVFVSHMPKRT

SEQ ID NO: 3471 - protein, 163 aa, Unknown; identical to SEQ ID NO: 3357
  Description of Unknown: uncultivated organism with predicted taxonomy: Clostridiales bacterium 42_27
  MG21-142 RuvC-III domain

SEQ ID NO: 3472 - protein, 163 aa, Unknown; identical to SEQ ID NO: 3434
  Description of Unknown: uncultivated organism with predicted taxonomy: Clostridiales bacterium 42_27
  MG21-143 RuvC-III domain

SEQ ID NO: 3473 - protein, 166 aa, Unknown; identical to SEQ ID NO: 3406
  Description of Unknown: uncultivated organism with predicted taxonomy: Clostridiales
  MG21-144 RuvC-III domain

SEQ ID NO: 3474 - protein, 163 aa, Unknown
  Description of Unknown: uncultivated organism with predicted taxonomy: Clostridiales
  MG21-145 RuvC-III domain
VDTQYLSRVIFRLIDENMAFAETGNYKRKTQTVSGAITAQVRKRLGIDKIRENGDLHHAADAAVIACISPGMVHKVTNYAKRCELYRDGQGYIDYETGEVMTKEAFDEKYAPRFPEPWPMFRKELEARLSADPRAEIEHLNLPAYDSSDELRPVFVSRMPRHK

SEQ ID NO: 3475 - protein, 186 aa, Unknown
  Description of Unknown: uncultivated organism with predicted taxonomy: Bacteroidales
  MG22-1 RuvC-III domain
NDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLR

SEQ ID NO: 3476 - protein, 186 aa, Unknown
  Description of Unknown: uncultivated organism with predicted taxonomy: Bacteroidales
  MG22-3 RuvC-III domain
SDTRYIARYIKGILSNIVRQRAADGTLEQEATSKNLIVCTGQITDRVKQDWGLNDVWNHIITPRFERLNRMTGSNDYGEWCCKEGKRYFQTRVPLHLQIGFNKKRIDHRHHAMDAIAIACVNRNVVNYLNNAAAHATDRMDLRMRICRPSGNGQTKKEIRSPWKNFAHDAECALQAITVSFKQNVR

SEQ ID NO: 3477 - protein, 186 aa, Unknown; identical to SEQ ID NO: 3476
  Description of Unknown: uncultivated organism with predicted taxonomy: Bacteroidales
  MG22-4 RuvC-III domain

SEQ ID NO: 3478 - protein, 186 aa, Unknown
  Description of Unknown: uncultivated organism with predicted taxonomy: Bacteroidales
  MG22-5 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3479 - protein, 186 aa, Unknown
  Description of Unknown: uncultivated organism with predicted taxonomy: Bacteroidales
  MG22-6 RuvC-III domain
NDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3480 - protein, 186 aa, Unknown; identical to SEQ ID NO: 3478
  Description of Unknown: uncultivated organism with predicted taxonomy: Prevotella
  MG22-7 RuvC-III domain

SEQ ID NO: 3481 - protein, 186 aa, Unknown; identical to SEQ ID NO: 3479
  Description of Unknown: uncultivated organism with predicted taxonomy: Bacteroidales
  MG22-8 RuvC-III domain

SEQ ID NO: 3482 - protein, 186 aa, Unknown
  Description of Unknown: uncultivated organism with predicted taxonomy: Bacteroidales
  MG22-9 RuvC-III domain
NDTRYIARFMKGFLSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLR

SEQ ID NO: 3483 - protein, 186 aa, Unknown
  Description of Unknown: uncultivated organism with predicted taxonomy: Bacteroidales
  MG22-10 RuvC-III domain
NDTRYIARFMKGILSNIVREKNADGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3484 - protein, 89 aa, Unknown
  Description of Unknown: uncultivated organism with predicted taxonomy: Prevotella sp. MGM2
  MG22-12 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYF

SEQ ID NO: 3485 - protein, 186 aa, Unknown
  Description of Unknown: uncultivated organism with predicted taxonomy: Prevotella
  MG22-13 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLSLQKGFNKKRIDHRHHAMDAIAIACVNRSIVNYLNNAAANQTEREDLRRAVCIPERNGQTKRQLRSPWLCFARDTENALRQIVVSFKQNLR

SEQ ID NO: 3486 - protein, 186 aa, Unknown; identical to SEQ ID NO: 3478
  Description of Unknown: uncultivated organism with predicted taxonomy: Prevotella sp. MGM2
  MG22-15 RuvC-III domain

SEQ ID NO: 3487 - protein, 186 aa, Unknown
  Description of Unknown: uncultivated organism with predicted taxonomy: Prevotella sp. MGM2
  MG22-16 RuvC-III domain
NDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLR

SEQ ID NO: 3488 - protein, 186 aa, Unknown
  Description of Unknown: uncultivated organism with predicted taxonomy: Prevotella
  MG22-17 RuvC-III domain
NDTRYIARFMKGILSNIVREKNTDGILEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3489 - protein, 186 aa, Unknown; identical to SEQ ID NO: 3487
  Description of Unknown: uncultivated organism with predicted taxonomy: Bacteroidales
  MG22-18 RuvC-III domain

SEQ ID NO: 3490 - protein, 186 aa, Unknown
  Description of Unknown: uncultivated organism with predicted taxonomy: Prevotella
  MG22-19 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLR

SEQ ID NO: 3491 - protein, 186 aa, Unknown
  Description of Unknown: uncultivated organism with predicted taxonomy: Bacteroidales
  MG22-21 RuvC-III domain
NDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3492 - protein, 186 aa, Unknown
  Description of Unknown: uncultivated organism with predicted taxonomy: Bacteroidales
  MG22-22 RuvC-III domain
NDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLR

SEQ ID NO: 3493 - protein, 185 aa, Unknown
  Description of Unknown: uncultivated organism with predicted taxonomy: Bacteroidales
  MG22-23 RuvC-III domain
TDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTR

SEQ ID NO: 3494 - protein, 186 aa, Unknown
  Description of Unknown: uncultivated organism with predicted taxonomy: Bacteroidales
  MG22-24 RuvC-III domain
NDTRYIARFMKGILSNIVREKNADGTLEPEETSKNLIVCSGRITDRVKQDWGLNDIWNHIITSRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3495 - protein, 186 aa, Unknown
  Description of Unknown: uncultivated organism with predicted taxonomy: Prevotella sp. MGM2
  MG22-25 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLR

SEQ ID NO: 3496 - protein, 186 aa, Unknown
  Description of Unknown: uncultivated organism with predicted taxonomy: Bacteroidales
  MG22-26 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLR

SEQ ID NO: 3497 - protein, 186 aa, Unknown
  Description of Unknown: uncultivated organism with predicted taxonomy: Prevotella sp. MGM2
  MG22-27 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLR

SEQ ID NO: 3498 - protein, 186 aa, Unknown; identical to SEQ ID NO: 3478
  Description of Unknown: uncultivated organism with predicted taxonomy: Bacteroidales
  MG22-28 RuvC-III domain

SEQ ID NO: 3499 - protein, 186 aa, Unknown
  Description of Unknown: uncultivated organism with predicted taxonomy: Bacteroidales
  MG22-29 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3500 - protein, 186 aa, Unknown
  Description of Unknown: uncultivated organism with predicted taxonomy: Prevotella sp. MGM2
  MG22-30 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLR

SEQ ID NO: 3501 - protein, 186 aa, Unknown; identical to SEQ ID NO: 3478
  Description of Unknown: uncultivated organism with predicted taxonomy: Bacteroidales
  MG22-31 RuvC-III domain

SEQ ID NO: 3502 - protein, 186 aa, Unknown; identical to SEQ ID NO: 3478
  Description of Unknown: uncultivated organism with predicted taxonomy: Bacteroidales
  MG22-33 RuvC-III domain

SEQ ID NO: 3503 - protein, 185 aa, Unknown
  Description of Unknown: uncultivated organism with predicted taxonomy: Bacteroidales
  MG22-34 RuvC-III domain
TDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTR

SEQ ID NO: 3504 - protein, 185 aa, Unknown; identical to SEQ ID NO: 3503
  Description of Unknown: uncultivated organism with predicted taxonomy: Parabacteroides sp. An277
  MG22-35 RuvC-III domain

SEQ ID NO: 3505 - protein, 185 aa, Unknown; identical to SEQ ID NO: 3493
  Description of Unknown: uncultivated organism with predicted taxonomy: Bacteroidales
  MG22-36 RuvC-III domain

SEQ ID NO: 3506 - protein, 186 aa, Unknown
  Description of Unknown: uncultivated organism with predicted taxonomy: Bacteroidales
  MG22-37 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENVLRQIVVSFKQNLR

SEQ ID NO: 3507 - protein, 186 aa, Unknown
  Description of Unknown: uncultivated organism with predicted taxonomy: Prevotella
  MG22-38 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRMPLSLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3508 - protein, 186 aa, Unknown; identical to SEQ ID NO: 3478
  Description of Unknown: uncultivated organism with predicted taxonomy: Prevotella sp. MGM2
  MG22-39 RuvC-III domain

SEQ ID NO: 3509 - protein, 185 aa, Unknown; identical to SEQ ID NO: 3503
  Description of Unknown: uncultivated organism with predicted taxonomy: Bacteroidales
  MG22-40 RuvC-III domain

SEQ ID NO: 3510 - protein, 186 aa, Unknown
  Description of Unknown: uncultivated organism with predicted taxonomy: Bacteroidales
  MG22-41 RuvC-III domain
NDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALQQIVVSFKQNLR

SEQ ID NO: 3511 - protein, 186 aa, Unknown; identical to SEQ ID NO: 3494
  Description of Unknown: uncultivated organism with predicted taxonomy: Prevotella
  MG22-42 RuvC-III domain

SEQ ID NO: 3512 - protein, 186 aa, Unknown
  Description of Unknown: uncultivated organism with predicted taxonomy: Bacteroidales
  MG22-43 RuvC-III domain
NDTRYIARFMKGILSNIVREKNADGTLESEETSKNLIVCSGRITDRVKQDWGLNDIWNHIITPRFERLNTKTSSDKFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLR

SEQ ID NO: 3513 - protein, 186 aa, Unknown
  Description of Unknown: uncultivated organism with predicted taxonomy: Bacteroidales
  MG22-44 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLR

SEQ ID NO: 3514 - protein, 186 aa, Unknown; identical to SEQ ID NO: 3513
  Description of Unknown: uncultivated organism with predicted taxonomy: Bacteroidales
  MG22-45 RuvC-III domain

SEQ ID NO: 3515 - protein, 185 aa, Unknown; identical to SEQ ID NO: 3503
  Description of Unknown: uncultivated organism with predicted taxonomy: Bacteroidales
  MG22-46 RuvC-III domain

SEQ ID NO: 3516 - protein, 186 aa, Unknown; identical to SEQ ID NO: 3478
  Description of Unknown: uncultivated organism with predicted taxonomy: Bacteroidales
  MG22-47 RuvC-III domain

SEQ ID NO: 3517 - protein, 185 aa, Unknown; identical to SEQ ID NO: 3503
  Description of Unknown: uncultivated organism with predicted taxonomy: Bacteroidales
  MG22-48 RuvC-III domain

SEQ ID NO: 3518 - protein, 186 aa, Unknown
  Description of Unknown: uncultivated organism with predicted taxonomy: Bacteroidales
  MG22-49 RuvC-III domain
NDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFAKDAENALRQIVVSFKQNLR

SEQ ID NO: 3519 - protein, 186 aa, Unknown; identical to SEQ ID NO: 3497
  Description of Unknown: uncultivated organism with predicted taxonomy: Bacteroidales
  MG22-50 RuvC-III domain

SEQ ID NO: 3520 - protein, 185 aa, Unknown
  Description of Unknown: uncultivated organism with predicted taxonomy: Prevotellaceae
  MG22-51 RuvC-III domain
TDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTR

SEQ ID NO: 3521 - protein, 6 aa, Unknown
  Description of Unknown: uncultivated organism with predicted taxonomy: Prevotella sp. MGM2
  MG22-52 RuvC-III domain
ITNRII

SEQ ID NO: 3522 - protein, 186 aa, Unknown
  Description of Unknown: uncultivated organism with predicted taxonomy: Bacteroidales
  MG22-53 RuvC-III domain
NDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3523 - protein, 186 aa, Unknown
  Description of Unknown: uncultivated organism with predicted taxonomy: Bacteroidales
  MG22-54 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLR

SEQ ID NO: 3524 - protein, 186 aa, Unknown; identical to SEQ ID NO: 3523
  Description of Unknown: uncultivated organism with predicted taxonomy: Bacteroidales
  MG22-55 RuvC-III domain

SEQ ID NO: 3525 - protein, 186 aa, Unknown
  Description of Unknown: uncultivated organism with predicted taxonomy: Bacteroidales
  MG22-56 RuvC-III domain
NDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWPCFARDTENALRQIVVSFKQNLR

SEQ ID NO: 3526 - protein, 186 aa, Unknown
  Description of Unknown: uncultivated organism with predicted taxonomy: Bacteroidales
  MG22-57 RuvC-III domain
NDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVYIPERNGQTKRQLRSPWHCFARDAENALRQIVVSFKQNLR

SEQ ID NO: 3527 - protein, 186 aa, Unknown; identical to SEQ ID NO: 3495
  Description of Unknown: uncultivated organism with predicted taxonomy: Bacteroidales
  MG22-58 RuvC-III domain

SEQ ID NO: 3528 - protein, 186 aa, Unknown; identical to SEQ ID NO: 3492
  Description of Unknown: uncultivated organism with predicted taxonomy: Bacteroidales
  MG22-59 RuvC-III domain

SEQ ID NO: 3529 - protein, 186 aa, Unknown; identical to SEQ ID NO: 3497
  Description of Unknown: uncultivated organism with predicted taxonomy: Bacteroidales
  MG22-60 RuvC-III domain

SEQ ID NO: 3530 - protein, 186 aa, Unknown
  Description of Unknown: uncultivated organism with predicted taxonomy: Bacteroidales
  MG22-61 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQIEREDLRRAVCIPERNGQTKRQLRSPWHCFARDAENALRQIVVSFKQNLR

SEQ ID NO: 3531 - protein, 186 aa, Unknown; identical to SEQ ID NO: 3495
  Description of Unknown: uncultivated organism with predicted taxonomy: Bacteroidales
  MG22-62 RuvC-III domain

SEQ ID NO: 3532 - protein, 186 aa, Unknown
  Description of Unknown: uncultivated organism with predicted taxonomy: Prevotella sp. MGM2
  MG22-64 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3533 - protein, 186 aa, Unknown
  Description of Unknown: uncultivated organism with predicted taxonomy: Prevotella
  MG22-65 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLR

SEQ ID NO: 3534 - protein, 40 aa, Unknown
  Description of Unknown: uncultivated organism with predicted taxonomy: Prevotella sp. MGM2
  MG22-66 RuvC-III domain
NDTRYIARFMKGILSNIVREKNADGTLEPEETSKNLIVCS

SEQ ID NO: 3535 - protein, 186 aa, Unknown; identical to SEQ ID NO: 3497
  Description of Unknown: uncultivated organism with predicted taxonomy: Bacteroidales
  MG22-68 RuvC-III domain

SEQ ID NO: 3536 - protein, 186 aa, Unknown
  Description of Unknown: uncultivated organism with predicted taxonomy: Bacteroidales
  MG22-69 RuvC-III domain
NDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAITIACVNRSIVNYLNNAAANQTEREDLRRAVCIPERNGQTKRQLRSPWHCFARDAENALRQIVVSFKQNLR

SEQ ID NO: 3537 - protein, 186 aa, Unknown
  Description of Unknown: uncultivated organism with predicted taxonomy: Bacteroidales
  MG22-70 RuvC-III domain
NDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLR

SEQ ID NO: 3538 - protein, 185 aa, Unknown; identical to SEQ ID NO: 3520
  Description of Unknown: uncultivated organism with predicted taxonomy: Bacteroidales
  MG22-71 RuvC-III domain

SEQ ID NO: 3539 - protein, 186 aa, Unknown
  Description of Unknown: uncultivated organism with predicted taxonomy: Bacteroidales
  MG22-72 RuvC-III domain
NDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3540 - protein, 186 aa, Unknown; identical to SEQ ID NO: 3487
  Description of Unknown: uncultivated organism with predicted taxonomy: Prevotella sp. MGM2
  MG22-73 RuvC-III domain

SEQ ID NO: 3541 - protein, 186 aa, Unknown; identical to SEQ ID NO: 3487
  Description of Unknown: uncultivated organism with predicted taxonomy: Bacteroidales
  MG22-74 RuvC-III domain

SEQ ID NO: 3542 - protein, 186 aa, Unknown
  Description of Unknown: uncultivated organism with predicted taxonomy: Bacteroidales
  MG22-75 RuvC-III domain
NDTRYIARFMKGILSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAIDAIAIACVNRSIVNYLNNAAANQTEREDLRRAVCIPERNGQTKRQLRSPWRNFAKDAENALRQIVVSFKQNLR

SEQ ID NO: 3543 - protein, 186 aa, Unknown; identical to SEQ ID NO: 3475
  Description of Unknown: uncultivated organism with predicted taxonomy: Bacteroidales
  MG22-76 RuvC-III domain

SEQ ID NO: 3544 - protein, 186 aa, Unknown; identical to SEQ ID NO: 3507
  Description of Unknown: uncultivated organism with predicted taxonomy: Prevotella
  MG22-77 RuvC-III domain

SEQ ID NO: 3545 - protein, 186 aa, Unknown; identical to SEQ ID NO: 3492
  Description of Unknown: uncultivated organism with predicted taxonomy: Bacteroidales
  MG22-78 RuvC-III domain

SEQ ID NO: 3546 - protein, 186 aa, Unknown
  Description of Unknown: uncultivated organism with predicted taxonomy: Bacteroidales
  MG22-79 RuvC-III domain
NDTRYIARFMKGILSNIVREKNTDGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDTENALRQIVVSFKQNLR

SEQ ID NO: 3547 - protein, 186 aa, Unknown
  Description of Unknown: uncultivated organism with predicted taxonomy: Bacteroidales
  MG22-80 RuvC-III domain
NDTRYIARFMKGILSNIVREKNADGTLEPEETSKNLIVCSGRITDSVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLR

SEQ ID NO: 3548 - protein, 185 aa, Unknown; identical to SEQ ID NO: 3520
  Description of Unknown: uncultivated organism with predicted taxonomy: Bacteroidales
  MG22-81 RuvC-III domain

SEQ ID NO: 3549 - protein, 186 aa, Unknown; identical to SEQ ID NO: 3533
  Description of Unknown: uncultivated organism with predicted taxonomy: Prevotella
  MG22-82 RuvC-III domain

SEQ ID NO: 3550 - protein, 186 aa, Unknown
  Description of Unknown: uncultivated organism with predicted taxonomy: Prevotella
  MG22-83 RuvC-III domain
NDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3551 - protein, 186 aa, Unknown
  Description of Unknown: uncultivated organism with predicted taxonomy: Bacteroidales
  MG22-84 RuvC-III domain
NDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDTENALRQIVVSFKQNLR

SEQ ID NO: 3552 - protein, 186 aa, Unknown
  Description of Unknown: uncultivated organism with predicted taxonomy: Prevotella
  MG22-85 RuvC-III domain
NDTRYIARFMKGILSNIVREKNADGTLEPEETSKNLIVCSGRITDRVKQDWGLNDIWNHIITQRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3553 - protein, 186 aa, Unknown; identical to SEQ ID NO: 3491
  Description of Unknown: uncultivated organism with predicted taxonomy: Bacteroidales
  MG22-86 RuvC-III domain

SEQ ID NO: 3554 - protein, 157 aa, Unknown
  Description of Unknown: uncultivated organism with predicted taxonomy: Prevotella sp. MGM2
  MG22-87 RuvC-III domain
NDTRYIARFMKGILSNIVREKNADGTLEPEETSKNLIVCSGRITDRVKQDWGLNDIWNHIVTPRFERLNTKTSSNDFGEYVCKEGKQYFQTRVPLNLQKGFNKKRIDHRHHAMDAIAIACVNRSIVNYLNNAAANQIEREALRRAVCIPERNGQTKR

SEQ ID NO: 3555 - protein, 186 aa, Unknown; identical to SEQ ID NO: 3522
  Description of Unknown: uncultivated organism with predicted taxonomy: Prevotella sp. MGM2
  MG22-88 RuvC-III domain

SEQ ID NO: 3556 - protein, 186 aa, Unknown; identical to SEQ ID NO: 3491
  Description of Unknown: uncultivated organism with predicted taxonomy: Prevotella sp. MGM2
  MG22-89 RuvC-III domain

SEQ ID NO: 3557 - protein, 186 aa, Unknown
  Description of Unknown: uncultivated organism with predicted taxonomy: Bacteroidales
  MG22-90 RuvC-III domain
NDTRYIARFMKGILSNIVREKNTDGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLR

SEQ ID NO: 3558 - protein, 186 aa, Unknown
  Description of Unknown: uncultivated organism with predicted taxonomy: Prevotella
  MG22-91 RuvC-III domain
NDTRYIVRFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLR

SEQ ID NO: 3559 - protein, 186 aa, Unknown; identical to SEQ ID NO: 3485
  Description of Unknown: uncultivated organism with predicted taxonomy: Bacteroidales
  MG22-92 RuvC-III domain

SEQ ID NO: 3560 - protein, 8 aa, Unknown
  Description of Unknown: uncultivated organism with predicted taxonomy: Bacteroides
  MG22-93 RuvC-III domain
ISMKSTWR

SEQ ID NO: 3561 - protein, 184 aa, Unknown
  Description of Unknown: uncultivated organism with predicted taxonomy: Prevotella
  MG22-94 RuvC-III domain
NDTRYISRYIIGELSKLVREEKPDGTLEQEPTSKNVVVLNGSVTDKLKKDWGLVDVWNEIITPRFRRLNEMEGSQRFGQDAEKGGKRYFQITMPLELQRGFQRKRIDHRHHAMDAITIACATRQVINYLNNDHSHAGQGREDLHRAVCRKRGSEWFIRKPWDTFTQDAHARLNQIVISFKQNLR

SEQ ID NO: 3562 - protein, 196 aa, Unknown
  Description of Unknown: uncultivated organism with predicted taxonomy: Bacteroidales
  MG22-95 RuvC-III domain
NDTRYISKVVKSLLSNVVRERDEEGNLEAEAISKNVIVPVGAMTDRLKQDWGLKDVWNQLMLPRFRALNDKMAPYRFTKITRRGHEIPAMPLELVKGFSKKRIDHRHHAMDAIAIACTTRRHIQYINGDAGEAEADKSKYIDKQRVIDARRTIRNKIAHRLDGDGKPIFDKPWTTFTEDVKRALENLIVSFKQTNK

SEQ ID NO: 3563 - protein, 187 aa, Unknown
  Description of Unknown: uncultivated organism with predicted taxonomy: Bacteroidales
  MG22-96 RuvC-III domain
NDSRYISKLMIGLLSNIVREETDGHLEEEAISKNLIVCTGKVTERLKQDWGLKDVWNEIIRPRFERLNQMEQTERFGHWENKQGKNVFQITIPIELSSSVDRKRIDHRHHAMDAITIACATRNMVNYLSNQASGKTRFDLQHALCIKQKMDAQGNYKWLIRKPWQTFTEDAKTALNEIVVSFKQNLR

SEQ ID NO: 3564 - protein, 187 aa, Unknown
  Description of Unknown: uncultivated organism with predicted taxonomy: Bacteroidetes
  MG22-97 RuvC-III domain
NDSRYISKLMIGLLSNIVREDADGQLEEEAISKNLIVCTGKVTERLKQDWGLKDVWNEIIRPRFERLNHMEQSERFGHWENKQGKNVFQITIPLELSSSVDRKRIDHRHHAMDAITIACATRNMVNYLSNQASGKARYDLQHVLCVKQKMDAQGNYKWLIRKPWQTFTEDAKAAIKEIVVSFKQNLR

SEQ ID NO: 3565 - protein, 69 aa, Unknown
  Description of Unknown: uncultivated organism with predicted taxonomy: Bacteroidales
  MG22-98 RuvC-III domain
TDTQYIASTMMRLLSNIVREQDPDGSLEREVRSKNPIVCTGGITDKLKKDWGVNDAWNRIILPRFKRMD

SEQ ID NO: 3566 - protein, 196 aa, Unknown
  Description of Unknown: uncultivated organism with predicted taxonomy: Flavobacteriales
  MG22-99 RuvC-III domain
NNTRYISRLVMTILSNIVRDDREDGKSDEGIRANRLITCQGGVTDKLKKDWHVNDVWNRIILPRYERMQNEVMKGVTFVTNNSRGHEIPTMPDKLKTEEYNPKRIDHRHHAMDAIVIACATRSIVNFLNNESARDEASEGSEKAKARQTYAELRSLLCVKDADNDEKVIRKPWENFEVDVLKALEDIVVSTKHKQR

SEQ ID NO: 3567 - protein, 184 aa, Unknown
  Description of Unknown: uncultivated organism with predicted taxonomy: Bacteroidales
  MG22-100 RuvC-III domain
NDTRYIARFIMGELSKLVRQQNADGTYEEEATSKNVIVLNGAITDKLKKDWGLVDVWNGIIAERFKRLNQMEGGTRFGHEENKDGKRYFQIEMPLELQRGFNRKRIDHRHHAMDAIVIACATRAVVNYLNNDHAHDGAGREDVKRAVSRKRDQTWLINKPWPTFTEEAKEELKQMVVSFKQNLR

SEQ ID NO: 3568 - protein, 184 aa, Unknown
  Description of Unknown: uncultivated organism with predicted taxonomy: Bacteroidales
  MG22-101 RuvC-III domain
NDTRYISRFIIGELSKLVREHNPDGTLEQEAVSKNILILNGAVTDKLKKDWGLVDVWNGIIAPRFRRLNAMEGSQRFGHEAMKDGKRYFQIEMPLELQRGFQRKRIDHRHHAMDAIAIACATRNVVNYLNNDHSHEGAGREDIKRAVSSKRSGQWLVNKPWSTFTQEARKQLQQIVVSFKQNLR

SEQ ID NO: 3569 - protein, 139 aa, Unknown
  Description of Unknown: uncultivated organism with predicted taxonomy: Clostridia
  MG23-1 RuvC-III domain
VETRQGTKAIADILKQALPDTEIVYVKAGLVSDFRQKFELYKVRALNDTHHAKDAYLNIVVGNTYSTKFTNNPLNFIKAGAKRPQDNQFKYNMDKIFDYNVISRGERAWIAGSDGSICTVKKFMSRNTVLITRKAKEVH

SEQ ID NO: 3570 - protein, 143 aa, Unknown
  Description of Unknown: uncultivated organism with predicted taxonomy: Firmicutes
  MG23-3 RuvC-III domain
VETRQGTKAITKILQQAFPDDDMEVVFTKAGVAAKLRHDFDLVKVRCVNDTHHAHDAYLNIVAGNVYNAKFTSNPLRFIKNEVKKGNASYHMDKIFFRDVKRGNKLVWQAPNNEEKTPGTIAIVREQLARRTVLQTRRSYMAH

SEQ ID NO: 3571 - protein, 142 aa, Unknown
  Description of Unknown: uncultivated organism with predicted taxonomy: Clostridiales
  MG23-4 RuvC-III domain
VETRQGTKAIIQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVH

SEQ ID NO: 3572 - protein, 143 aa, Unknown
  Description of Unknown: uncultivated organism with predicted taxonomy: Firmicutes
  MG23-5 RuvC-III domain
VETRQGTKAITQILKRVFKNEAVEIIFTKAELISDFRRIFDLPKVRCVNSTHHAHDAYLNIVVGNVYNAKFTKHPRHFIEECQRKGSYDYNMYRMFDYDVKCGSKIVWCGSKITTCGKGTISTVKKQLQKRSVLLTKKSFMKH

SEQ ID NO: 3573 - protein, 143 aa, Unknown
  Description of Unknown: uncultivated organism with predicted taxonomy: Clostridiales
  MG23-6 RuvC-III domain
VETRQGTKAITQILKEAFKNDDTRIVFTKAEVTADFRHKYDLPKARSVNNLHHAHDAYLNIVAGNVYDAKFTSHPINFIKECRNKGVFNYNMAKVFDYNVKRGNRYVWIAQNDGMDMPLTIERVKNQLARNTILMTRRSYMAH

SEQ ID NO: 3574 - protein, 142 aa, Unknown; identical to SEQ ID NO: 3571
  Description of Unknown: uncultivated organism with predicted taxonomy: Clostridiales
  MG23-7 RuvC-III domain

SEQ ID NO: 3575 - protein, 142 aa, Unknown
  Description of Unknown: uncultivated organism with predicted taxonomy: Clostridiales
  MG23-8 RuvC-III domain
VETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVH

SEQ ID NO: 3576 - protein, 142 aa, Unknown; identical to SEQ ID NO: 3575
  Description of Unknown: uncultivated organism with predicted taxonomy: Clostridiales
  MG23-9 RuvC-III domain

SEQ ID NO: 3577 - protein, 139 aa, Unknown
  Description of Unknown: uncultivated organism with predicted taxonomy: Clostridiales
  MG23-10 RuvC-III domain
VETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVH

SEQ ID NO: 3578 - protein, 139 aa, Unknown
  Description of Unknown: uncultivated organism with predicted taxonomy: Butyrivibrio sp. CAG:318
  MG23-11 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYH

SEQ ID NO: 3579 - protein, 139 aa, Unknown
  Description of Unknown: uncultivated organism with predicted taxonomy: Butyrivibrio sp. CAG:318
  MG23-12 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEAN

SEQ ID NO: 3580 - protein, 139 aa, Unknown
  Description of Unknown: uncultivated organism with predicted taxonomy: Clostridium sp. AF36-4
  MG23-13 RuvC-III domain
VETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVH

SEQ ID NO: 3581 - protein, 139 aa, Unknown; identical to SEQ ID NO: 3578
  Description of Unknown: uncultivated organism with predicted taxonomy: Butyrivibrio sp. CAG:318
  MG23-14 RuvC-III domain

SEQ ID NO: 3582 - protein, 139 aa, Unknown; identical to SEQ ID NO: 3578
  Description of Unknown: uncultivated organism with predicted taxonomy: Butyrivibrio sp. CAG:318
  MG23-15 RuvC-III domain

SEQ ID NO: 3583 - protein, 139 aa, Unknown; identical to SEQ ID NO: 3580
  Description of Unknown: uncultivated organism with predicted taxonomy: Clostridium sp. AF36-4
  MG23-16 RuvC-III domain

SEQ ID NO: 3584 - protein, 139 aa, Unknown; identical to SEQ ID NO: 3579
  Description of Unknown: uncultivated organism with predicted taxonomy: Butyrivibrio sp. CAG:318
  MG23-17 RuvC-III domain

SEQ ID NO: 3585 - protein, 139 aa, Unknown
  Description of Unknown: uncultivated organism with predicted taxonomy: Clostridiales
  MG23-18 RuvC-III domain
VETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVH

SEQ ID NO: 3586 - protein, 139 aa, Unknown; identical to SEQ ID NO: 3578
  Description of Unknown: uncultivated organism with predicted taxonomy: Butyrivibrio sp. CAG:318
  MG23-19 RuvC-III domain

SEQ ID NO: 3587 - protein, 139 aa, Unknown; identical to SEQ ID NO: 3578
  Description of Unknown: uncultivated organism with predicted taxonomy: Butyrivibrio sp. CAG:318
  MG23-20 RuvC-III domain

SEQ ID NO: 3588 - protein, 48 aa, Unknown
  Description of Unknown: uncultivated organism with predicted taxonomy: Butyrivibrio sp. CAG:318
  MG23-21 RuvC-III domain
VETRQGTKAITQVLKQAFPNTQIVFVKAGIVSDFRKKFDINKVRALND

SEQ ID NO: 3589 - protein, 139 aa, Unknown; identical to SEQ ID NO: 3578
  Description of Unknown: uncultivated organism with predicted taxonomy: Butyrivibrio sp. CAG:318
  MG23-22 RuvC-III domain

SEQ ID NO: 3590 - protein, 139 aa, Unknown; identical to SEQ ID NO: 3579
  Description of Unknown: uncultivated organism with predicted taxonomy: Butyrivibrio sp. CAG:318
  MG23-23 RuvC-III domain

SEQ ID NO: 3591 - protein, 139 aa, Unknown
  Description of Unknown: uncultivated organism with predicted taxonomy: Clostridiales
  MG23-24 RuvC-III domain
VETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVH

SEQ ID NO: 3592 - protein, 139 aa, Unknown
  Description of Unknown: uncultivated organism with predicted taxonomy: Butyrivibrio sp. CAG:318
  MG23-25 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYH

SEQ ID NO: 3593 - protein, 139 aa, Unknown; identical to SEQ ID NO: 3578
  Description of Unknown: uncultivated organism with predicted taxonomy: Butyrivibrio sp. CAG:318
  MG23-26 RuvC-III domain

SEQ ID NO: 3594 - protein, 139 aa, Unknown; identical to SEQ ID NO: 3578
  Description of Unknown: uncultivated organism with predicted taxonomy: Butyrivibrio sp. CAG:318
  MG23-27 RuvC-III domain

SEQ ID NO: 3595 - protein, 139 aa, Unknown; identical to SEQ ID NO: 3579
  Description of Unknown: uncultivated organism with predicted taxonomy: Butyrivibrio sp. CAG:318
  MG23-28 RuvC-III domain

SEQ ID NO: 3596 - protein, 139 aa, Unknown; identical to SEQ ID NO: 3578
  Description of Unknown: uncultivated organism with predicted taxonomy: Butyrivibrio sp. CAG:318
  MG23-29 RuvC-III domain

SEQ ID NO: 3597 - protein, 139 aa, Unknown; identical to SEQ ID NO: 3578
  Description of Unknown: uncultivated organism with predicted taxonomy: Butyrivibrio sp. CAG:318
  MG23-30 RuvC-III domain

SEQ ID NO: 3598 - protein, 139 aa, Unknown; identical to SEQ ID NO: 3578
  Description of Unknown: uncultivated organism with predicted taxonomy: Butyrivibrio sp. CAG:318
  MG23-31 RuvC-III domain

SEQ ID NO: 3599 - protein, 139 aa, Unknown; identical to SEQ ID NO: 3592
  Description of Unknown: uncultivated organism with predicted taxonomy: Butyrivibrio sp. CAG:318
  MG23-32 RuvC-III domain

SEQ ID NO: 3600 - protein, 139 aa, Unknown; identical to SEQ ID NO: 3591
  Description of Unknown: uncultivated organism with predicted taxonomy: Clostridiales
  MG23-33 RuvC-III domain

SEQ ID NO: 3601 - protein, 139 aa, Unknown
  Description of Unknown: uncultivated organism with predicted taxonomy: Butyrivibrio sp. CAG:318
  MG23-34 RuvC-III domain
VETRQGTKAISQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYH

SEQ ID NO: 3602 - protein, 139 aa, Unknown
  Description of Unknown: uncultivated organism with predicted taxonomy: Butyrivibrio sp. CAG:318
  MG23-35 RuvC-III domain
VETRQGTKAITQILKQAFPNTQIVFVKAGIVSDFRKKFDINKVRALNDTHHAKDAYLNIVVGNTYYTKFTNNPMNFIKDASKNPKNDFYRYNMDKIFDYNVIRNGEEAWIADNGKTKQHVLRIMKKNSVTITVKTEEYH

SEQ ID NO: 3603 - protein, 139 aa, Unknown; identical to SEQ ID NO: 3591
  Description of Unknown: uncultivated organism with predicted taxonomy: Clostridiales
  MG23-36 RuvC-III domain

SEQ ID NO: 3604 - protein, 139 aa, Unknown; identical to SEQ ID NO: 3591
  Description of Unknown: uncultivated organism with predicted taxonomy: Clostridiales
  MG23-37 RuvC-III domain

SEQ ID NO: 3605 - protein, 139 aa, Unknown; identical to SEQ ID NO: 3578
  Description of Unknown: uncultivated organism with predicted taxonomy: Butyrivibrio sp. CAG:318
  MG23-38 RuvC-III domain

SEQ ID NO: 3606 - protein, 139 aa, Unknown; identical to SEQ ID NO: 3578
  Description of Unknown: uncultivated organism with predicted taxonomy: Butyrivibrio sp. CAG:318
  MG23-39 RuvC-III domain

SEQ ID NO: 3607 - protein, 139 aa, Unknown; identical to SEQ ID NO: 3592
  Description of Unknown: uncultivated organism with predicted taxonomy: Butyrivibrio sp. CAG:318
  MG23-40 RuvC-III domain

SEQ ID NO: 3608 - protein, 139 aa, Unknown; identical to SEQ ID NO: 3591
  Description of Unknown: uncultivated organism with predicted taxonomy: Clostridiales
  MG23-41 RuvC-III domain

SEQ ID NO: 3609 - protein, 139 aa, Unknown; identical to SEQ ID NO: 3592
  Description of Unknown: uncultivated organism with predicted taxonomy: Butyrivibrio sp. CAG:318
  MG23-42 RuvC-III domain

SEQ ID NO: 3610 - protein, 139 aa, Unknown; identical to SEQ ID NO: 3578
  Description of Unknown: uncultivated organism with predicted taxonomy: Butyrivibrio sp. CAG:318
  MG23-43 RuvC-III domain

SEQ ID NO: 3611 - protein, 139 aa, Unknown; identical to SEQ ID NO: 3579
  Description of Unknown: uncultivated organism with predicted taxonomy: Butyrivibrio sp. CAG:318
  MG23-44 RuvC-III domain

SEQ ID NO: 3612 - protein, 97 aa, Unknown
  Description of Unknown: uncultivated organism with predicted taxonomy: Butyrivibrio sp. CAG:318
  MG23-45 RuvC-III domain
VETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIF

SEQ ID NO: 3613 - protein, 139 aa, Unknown; identical to SEQ ID NO: 3591
  Description of Unknown: uncultivated organism with predicted taxonomy: Clostridiales
  MG23-46 RuvC-III domain

SEQ ID NO: 3614 - protein, 139 aa, Unknown; identical to SEQ ID NO: 3592
  Description of Unknown: uncultivated organism with predicted taxonomy: Butyrivibrio sp. CAG:318
  MG23-47 RuvC-III domain

SEQ ID NO: 3615 - protein, 139 aa, Unknown; identical to SEQ ID NO: 3578
  Description of Unknown: uncultivated organism with predicted taxonomy: Butyrivibrio sp. CAG:318
  MG23-48 RuvC-III domain

SEQ ID NO: 3616 - protein, 33 aa, Unknown
  Description of Unknown: uncultivated organism with predicted taxonomy: Clostridiales
  MG23-49 RuvC-III domain
VETGQGTKVITQILKQAFPDTQVVFVKARMVSD

SEQ ID NO: 3617 - protein, 139 aa, Unknown
  Description of Unknown: uncultivated organism with predicted taxonomy: Clostridiales
  MG23-50 RuvC-III domain
VETRQGTKAVTQILKQAFPDTQIIFVKAGVVSDFRKKFNINKVRALNDTHHAKDAYLNIVVGNIYNTKFTSNPINFIKDARKNVNDISYKYNMDKMFDYNVCRNGENAWIADNGKSKQHVLSVLGKNSVIITRKTEENH

SEQ ID NO: 3618 - protein, 139 aa, Unknown; identical to SEQ ID NO: 3591
  Description of Unknown: uncultivated organism with predicted taxonomy: Clostridiales
  MG23-51 RuvC-III domain

SEQ ID NO: 3619 - protein, 139 aa, Unknown; identical to SEQ ID NO: 3592
  Description of Unknown: uncultivated organism with predicted taxonomy: Butyrivibrio sp. CAG:318
  MG23-52 RuvC-III domain

SEQ ID NO: 3620 - protein, 139 aa, Unknown; identical to SEQ ID NO: 3578
  Description of Unknown: uncultivated organism with predicted taxonomy: Butyrivibrio sp. CAG:318
  MG23-53 RuvC-III domain

SEQ ID NO: 3621 - protein, 139 aa, Unknown; identical to SEQ ID NO: 3579
  Description of Unknown: uncultivated organism with predicted taxonomy: Butyrivibrio sp. CAG:318
  MG23-54 RuvC-III domain

SEQ ID NO: 3622 - protein, 139 aa, Unknown; identical to SEQ ID NO: 3578
  Description of Unknown: uncultivated organism with predicted taxonomy: Butyrivibrio sp. CAG:318
  MG23-55 RuvC-III domain

SEQ ID NO: 3623 - protein, 139 aa, Unknown; identical to SEQ ID NO: 3579
  Description of Unknown: uncultivated organism with predicted taxonomy: Butyrivibrio sp. CAG:318
  MG23-56 RuvC-III domain

SEQ ID NO: 3624 - protein, 139 aa, Unknown; identical to SEQ ID NO: 3578
  Description of Unknown: uncultivated organism with predicted taxonomy: Butyrivibrio sp. CAG:318
  MG23-57 RuvC-III domain

SEQ ID NO: 3625 - protein, 139 aa, Unknown; identical to SEQ ID NO: 3579
  Description of Unknown: uncultivated organism with predicted taxonomy: Butyrivibrio sp. CAG:318
  MG23-58 RuvC-III domain

SEQ ID NO: 3626 - protein, 139 aa, Unknown; identical to SEQ ID NO: 3580
  Description of Unknown: uncultivated organism with predicted taxonomy: Clostridiales
  MG23-59 RuvC-III domain

SEQ ID NO: 3627 - protein, 139 aa, Unknown; identical to SEQ ID NO: 3585
  Description of Unknown: uncultivated organism with predicted taxonomy: Clostridiales
  MG23-60 RuvC-III domain

SEQ ID NO: 3628 - protein, 139 aa, Unknown; identical to SEQ ID NO: 3601
  Description of Unknown: uncultivated organism with predicted taxonomy: Butyrivibrio sp. CAG:318
  MG23-62 RuvC-III domain

SEQ ID NO: 3629 - protein, 139 aa, Unknown; identical to SEQ ID NO: 3579
  Description of Unknown: uncultivated organism with predicted taxonomy: Butyrivibrio sp. CAG:318
  MG23-63 RuvC-III domain

SEQ ID NO: 3630 - protein, 139 aa, Unknown; identical to SEQ ID NO: 3591
  Description of Unknown: uncultivated organism with predicted taxonomy: Clostridiales
  MG23-64 RuvC-III domain

SEQ ID NO: 3631 - protein, 139 aa, Unknown; identical to SEQ ID NO: 3577
  Description of Unknown: uncultivated organism with predicted taxonomy: Clostridiales
  MG23-65 RuvC-III domain

SEQ ID NO: 3632 - protein, 139 aa, Unknown
  Description of Unknown: uncultivated organism with predicted taxonomy: Butyrivibrio sp. CAG:318
  MG23-66 RuvC-III domain
VETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWISDNGKTKQHVLRIMKKNSVTITVKTEEAH

SEQ ID NO: 3633 - protein, 139 aa, Unknown; identical to SEQ ID NO: 3579
  Description of Unknown: uncultivated organism with predicted taxonomy: Butyrivibrio sp. CAG:318
  MG23-67 RuvC-III domain

SEQ ID NO: 3634 - protein, 139 aa, Unknown
  Description of Unknown: uncultivated organism with predicted taxonomy: Butyrivibrio sp. CAG:318
  MG23-68 RuvC-III domain
VETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYH

SEQ ID NO: 3635 - protein, 139 aa, Unknown; identical to SEQ ID NO: 3578
  Description of Unknown: uncultivated organism with predicted taxonomy: Butyrivibrio sp. CAG:318
  MG23-69 RuvC-III domain

SEQ ID NO: 3636 - protein, 139 aa, Unknown; identical to SEQ ID NO: 3592
  Description of Unknown: uncultivated organism with predicted taxonomy: Butyrivibrio sp. CAG:318
  MG23-70 RuvC-III domain

SEQ ID NO: 3637 - protein, 139 aa, Unknown
  Description of Unknown: uncultivated organism with predicted taxonomy: Eubacterium
  MG23-72 RuvC-III domain
VETRQGTKAITQILKQAFPDTQIIFVKAGVVSDFRKKFNINKVRALNDTHHAKDAYLNIVVGNIYNTKFTSNPINFIKDARKNVNDVSYKYNMDKMFDYNVCRNGENAWIADNGKSKQHVLSVLGKNSVIITRKTEENH

SEQ ID NO: 3638 - protein, 162 aa, Unknown
  Description of Unknown: uncultivated organism with predicted taxonomy: Candidatus Melainabacteria
  MG1-4 HNH domain
DNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGL

SEQ ID NO: 3639 - protein, 158 aa, Unknown
  Description of Unknown: uncultivated organism with predicted taxonomy: Verrucomicrobia
  MG1-5 HNH domain
DDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDKTPFEWLSSDKTKWESYCDRVRSLTQSLGAKRCKLLVSPNAEELMQKYTAL

SEQ ID NO: 3640 - protein, 152 aa, Unknown
  Description of Unknown: uncultivated organism with predicted taxonomy: unclassified Verrucomicrobia (miscellaneous)
  MG1-6 HNH domain
DDFMGEKEKKEMRIAMKKRAEEKMMIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3641 - protein, 152 aa, Unknown
  Description of Unknown: uncultivated organism with predicted taxonomy: unclassified Verrucomicrobia (miscellaneous)
  MG1-7 HNH domain
EDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTAL

SEQ ID NO: 3642 - protein, 153 aa, Unknown
  Description of Unknown: uncultivated organism
  MG1-1 HNH domain
EDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTAL

SEQ ID NO: 3643 - protein, 151 aa, Unknown
  Description of Unknown: uncultivated organism with predicted taxonomy: Verrucomicrobia
  MG1-2 HNH domain
EDFMGEKAKIEYRKFLNRREKERKEAREQAGQLGATSGSSGLKMELFKAQRGQCLYSGQRLHETKIEDYVIEHIVPRAKRGPDAVINYVLTTEELNNDKSDHIPFEWPYLKKQWDAYTQRVESCAGALGVKRVRLLVSPDAVELAQKYTAL

SEQ ID NO: 3644 - protein, 167 aa, Unknown
  Description of Unknown: uncultivated organism
  MG1-3 HNH domain
DPPRNARQRAERQKEIEANREKREKLFEQYGIEDSGVASKRRRIMLYEQQRGKCPYTGRDLPSNPLDPSLEIEHIFPVEMGGLSVDDNLVLTWRSVNAEKGKRTPLQWAGERFDAMLANTRDMRWSARKREIFAWGTIREDKPDKPSHYNADGTLRVPDFGNTTRTA

SEQ ID NO: 3645 - protein, 167 aa, Unknown; identical to SEQ ID NO: 3644
  Description of Unknown: uncultivated organism
  MG1-13 HNH domain

SEQ ID NO: 3646 - protein, 153 aa, Unknown
  Description of Unknown: uncultivated organism
  MG1-8 HNH domain
EDFMGEQAKRELQTFQKRREQARAEAEAEAAKLGLESRSSALRYELFKAQGGICLYTGRPLSETQLDQYEIDHIVPRSLGGPDAMVNYVLTFPEVNSAKEKGKLTPYALLHGTDGWDAYVARVKARAAALRNKKVQLLTREDAPELVERYTAL

SEQ ID NO: 3647 - protein, 160 aa, Unknown
  Description of Unknown: uncultivated organism with predicted taxonomy: Verrucomicrobia
  MG1-9 HNH domain
DDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTAL

SEQ ID NO: 3648 - protein, 166 aa, Unknown
  Description of Unknown: uncultivated organism
  MG1-10 HNH domain
QAPRTETQKKEIEVEQKNNRASKDKMASEFGVGEGKLGRSKYFRIALWKQQGGSKTTKAICPFTGKTLDVDDPLSPQLELAHLYPDTKGGLYMMDNLVLTTREVNKAMDNMTPVEAARAGIFGISCDEMIRRSEQFAWGESKRKLFRFEPTAEESFPDFNNMTRIS

SEQ ID NO: 3649 - protein, 166 aa, Unknown
  Description of Unknown: uncultivated organism
  MG1-11 HNH domain
NPACNTKQASEIQKQNDARRKRKEELCRAYGCANPTHAEMLRLQLFEEQGGKRKGEAPAICPFTGESLGTDPLSPHLELAHIFPDARGGLYIRENLVLTTARTNRDMNNRTPIEAAEASLPGWSRWETIEQRIRHFRWNAKKLELFTFRPTPEQPIPDFNNMTRTA

SEQ ID NO: 3650 - protein, 161 aa, Unknown
  Description of Unknown: uncultivated organism
  MG1-12 HNH domain
DMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIA

SEQ ID NO: 3651 - protein, 153 aa, Unknown; identical to SEQ ID NO: 3642
  Description of Unknown: uncultivated organism
  MG1-14 HNH domain

SEQ ID NO: 3652 - protein, 157 aa, Unknown
  Description of Unknown: uncultivated organism
  MG1-20 HNH domain
DFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGL

SEQ ID NO: 3653 - protein, 157 aa, Unknown; identical to SEQ ID NO: 3652
  Description of Unknown: uncultivated organism with predicted taxonomy: Candidatus Peregrinibacteria bacterium CG10_big_fil_rev_8_21_14_0_10_54_7
  MG1-21 HNH domain

SEQ ID NO: 3654 - protein, 157 aa, Unknown; identical to SEQ ID NO: 3652
  Description of Unknown: uncultivated organism with predicted taxonomy: Candidatus Peregrinibacteria bacterium CG10_big_fil_rev_8_21_14_0_10_54_7
  MG1-22 HNH domain

SEQ ID NO: 3655 - protein, 155 aa, Unknown
  Description of Unknown: uncultivated organism with predicted taxonomy: Candidatus Melainabacteria bacterium
  MG1-23 HNH domain
DNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGL

SEQ ID NO: 3656 - protein, 155 aa, Unknown
  Description of Unknown: uncultivated organism
  MG1-24 HNH domain
DNSLFGKAKAQAAETNMREMEKRNQQLIEELKNYDAYSSKNFEKLKLLKIQCGQCAYSGEKIGIGDFNKCEIDHIYPRAMGGNDALYNKVLCYRVENQKKQDRTPYEWLSSNKEQWANYVFRLNKIKQSLGKKKFELLTSKPEDCAKLIDSYNGL

SEQ ID NO: 3657 - protein, 155 aa, Unknown
  Description of Unknown: uncultivated organism
  MG1-25 HNH domain
DNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGL

SEQ ID NO: 3658 - protein, 162 aa, Unknown
  Description of Unknown: uncultivated organism
  MG1-26 HNH domain
DNSLYGSKKAQDTEKYMKQQEKENEQIIKELKEAGLYVNGQNHANATYFLMHKLLKSQGGACAYSGQKIAPSNYDECEIDHIYPRTLGGNDALYNKVVCYRRENQDKKGRTPYEWLSSDNDKWANYVNRLNKIKKQLGKKKFELLTSKPEDCEKLIESYNGL

SEQ ID NO: 3659 - protein, 155 aa, Unknown
  Description of Unknown: uncultivated organism
  MG1-27 HNH domain
DNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGL

SEQ ID NO: 3660 - protein, 155 aa, Unknown
  Description of Unknown: uncultivated organism
  MG1-28 HNH domain
DNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGL

SEQ ID NO: 3661 - protein, 155 aa, Unknown; identical to SEQ ID NO: 3656
  Description of Unknown: uncultivated organism
  MG1-29 HNH domain

SEQ ID NO: 3662 - protein, 155 aa, Unknown; identical to SEQ ID NO: 3660
  Description of Unknown: uncultivated organism
  MG1-30 HNH domain

SEQ ID NO: 3663 - protein, 155 aa, Unknown; identical to SEQ ID NO: 3659
  Description of Unknown: uncultivated organism
  MG1-31 HNH domain

SEQ ID NO: 3664 - protein, 155 aa, Unknown
  Description of Unknown: uncultivated organism
  MG1-32 HNH domain
DNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSNPENCKELIKSYNGL

SEQ ID NO: 3665 - protein, 155 aa, Unknown; identical to SEQ ID NO: 3659
  Description of Unknown: uncultivated organism
  MG1-33 HNH domain

SEQ ID NO: 3666 - protein, 162 aa, Unknown; identical to SEQ ID NO: 3658
  Description of Unknown: uncultivated organism with predicted taxonomy: Candidatus Gastranaerophilales bacterium HUM_9
  MG1-34 HNH domain

SEQ ID NO: 3667 - protein, 155 aa, Unknown; identical to SEQ ID NO: 3657
  Description of Unknown: uncultivated organism
  MG1-35 HNH domain

SEQ ID NO: 3668 - protein, 157 aa, Unknown
  Description of Unknown: uncultivated organism with predicted taxonomy: Clostridium
  MG1-36 HNH domain
ELGKGKSEREKIKKQKQENLGKTSRIKEELQAQGIENPTGTEITKYKLWKEQTNYCMYSGKKIDIEQVFSSETQINYIIPFWMCFDDTYKNKILTFTSEVKQKQDLMPYQYIQKMRRDTEEYETRISMLIRVYSKKNRLVKKNITKEEMIKWRNRNI

SEQ ID NO: 3669 - protein, 155 aa, Unknown; identical to SEQ ID NO: 3657
  Description of Unknown: uncultivated organism
  MG1-37 HNH domain

SEQ ID NO: 3670 - protein, 155 aa, Unknown; identical to SEQ ID NO: 3655
  Description of Unknown: uncultivated organism with predicted taxonomy: Candidatus Melainabacteria bacterium
  MG1-38 HNH domain

SEQ ID NO: 3671 - protein, 155 aa, Unknown; identical to SEQ ID NO: 3659
  Description of Unknown: uncultivated organism
  MG1-39 HNH domain

SEQ ID NO: 3672 - protein, 155 aa, Unknown; identical to SEQ ID NO: 3664
  Description of Unknown: uncultivated organism
  MG1-40 HNH domain

SEQ ID NO: 3673 - protein, 162 aa, Unknown; identical to SEQ ID NO: 3658
  Description of Unknown: uncultivated organism with predicted taxonomy: Candidatus Gastranaerophilales bacterium HUM_9
  MG1-41 HNH domain

SEQ ID NO: 3674 - protein, 155 aa, Unknown; identical to SEQ ID NO: 3659
  Description of Unknown: uncultivated organism
  MG1-42 HNH domain

SEQ ID NO: 3675 - protein, 155 aa, Unknown; identical to SEQ ID NO: 3659
  Description of Unknown: uncultivated organism
  MG1-43 HNH domain

SEQ ID NO: 3676 - protein, 155 aa, Unknown; identical to SEQ ID NO: 3660
  Description of Unknown: uncultivated organism
  MG1-44 HNH domain

SEQ ID NO: 3677 - protein, 162 aa, Unknown; identical to SEQ ID NO: 3658
  Description of Unknown: uncultivated organism with predicted taxonomy: Candidatus Melainabacteria
  MG1-45 HNH domain

SEQ ID NO: 3678 - protein, 155 aa, Unknown; identical to SEQ ID NO: 3660
  Description of Unknown: uncultivated organism
  MG1-46 HNH domain

SEQ ID NO: 3679 - protein, 155 aa, Unknown; identical to SEQ ID NO: 3659
  Description of Unknown: uncultivated organism
  MG1-47 HNH domain

SEQ ID NO: 3680 - protein, 155 aa, Unknown
  Description of Unknown: uncultivated organism
  MG1-48 HNH domain
DNSLYGAKKANGYLKNIKENEKENNEIKKELEEANAYSPTNFEKLKLLRMQCGKCVYSGKNISINDFDSCEIDHVYPRTMGGNDALYNRVLCYSIENQNKAGRTPYEWLSSDKELWANYVARLNDIKGSLGKKKFELLTSKPEVCEKLIESYNGL

SEQ ID NO: 3681 - protein, 153 aa, Unknown
  Description of Unknown: uncultivated organism
  MG1-49 HNH domain
DNSLFGAEKAKATEQMMRINEKKNEEIRNNLSDDYSAINFLKYKLAEMQDWTCIYSGRKIEITDFDACEIDHIFPRTDDTNDALYNKVICYKEEIADKHGRTPYEWMNNNTARWQEYIMRVKSLSQKSGKTKTALLTLSPTQSEKFLEKRKAL

SEQ ID NO: 3682 - protein, 153 aa, Unknown; identical to SEQ ID NO: 3681
  Description of Unknown: uncultivated organism
  MG1-50 HNH domain

SEQ ID NO: 3683 - protein, 154 aa, Unknown
  Description of Unknown: uncultivated organism with predicted taxonomy: Candidatus Melainabacteria bacterium
  MG1-51 HNH domain
DNSLYGAQKANNYLISIKANEKENNEIKKELEDANAYSNTNFDKLKLLRMQGGRCIYSGEKIGISNFEQCDIDHIFPRSRGGNDALYNKVLCYSKENRIKGDKVPYEWLNNTENWDIYLQRTRDLKGSLGKKKFELLTSKPDQCEKLIESYNGL

SEQ ID NO: 3684 - protein, 155 aa, Unknown
  Description of Unknown: uncultivated organism
  MG1-52 HNH domain
DNSLYGAKKSNDYLKNIKENEKENLEIKKELEDVDRYSPTNFEKLKLLRMQGGKCIYSGKPICIDDFDKCEIDHIYPRTMGGNDALYNRVLCYSIENQNKKGRTPYEWLSNDKEYWSAYVDRLNKIKGSLGKKKFELLTSKPEDCEKLIESYNGL

SEQ ID NO: 3685 - protein, 153 aa, Unknown; identical to SEQ ID NO: 3681
  Description of Unknown: uncultivated organism
  MG1-53 HNH domain

SEQ ID NO: 3686 - protein, 153 aa, Unknown; identical to SEQ ID NO: 3681
  Description of Unknown: uncultivated organism
  MG1-54 HNH domain

SEQ ID NO: 3687 - protein, 153 aa, Unknown; identical to SEQ ID NO: 3681
  Description of Unknown: uncultivated organism
  MG1-55 HNH domain

SEQ ID NO: 3688 - protein, 155 aa, Unknown
  Description of Unknown: uncultivated organism
  MG1-56 HNH domain
DNSLEGQKRAKDTENYMKAQAKENEQIKKELEEQNALSGINFEKLKLLKMQGGKCIYSGQNIGISDFDKCEIDHIYPRTMGGNDALYNRVLCYRIENQDKKGRTPYEWLSHDEEQWAAYVHRLSEIKQILGKKKFELLTSKPEDCAKIIDSYNGL

SEQ ID NO: 3689 - protein, 153 aa, Unknown
  Description of Unknown: uncultivated organism
  MG1-57 HNH domain
DNSLFGAEKAKATEQMMKNNEKKNEEIKKNLGDDYSAINFLKYKLAEMQDWKCIYSGRKIGITDFAACEIDHIFPRTDDGNDALYNKVICYKEENADKLGRTPYEWLYHNIARWQEYVTRVKSLSQKLGKTKTALLTLPPEQSEKLLEKKNAL

SEQ ID NO: 3690 - protein, 185 aa, Unknown
  Description of Unknown: uncultivated organism with predicted taxonomy: Candidatus Termititenax aidoneus
  MG1-58 HNH domain
DNSVLSGAKAEGYKLLCEQNYAKNEKLKNDLGDDFSPQNLIKLKLLESQNFQCIYSGNNIAPTDLDACEIDHIYPRTMGGNDALYNKVLCYSIENQNKKGRTPYEWFHQEKTEEEWIEYKNRCFNFLNKYPIPKKVKRRQDNHISKSIKEYYVKLSEYKLAKKKFELLTSKPEDCEKLIESYNGL

SEQ ID NO: 3691 - protein, 158 aa, Unknown
  Description of Unknown: uncultivated organism with predicted taxonomy: Verrucomicrobia
  MG1-59 HNH domain
DDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTAF

SEQ ID NO: 3692 - protein, 152 aa, Unknown
  Description of Unknown: uncultivated organism with predicted taxonomy: unclassified Verrucomicrobia (miscellaneous)
  MG1-60 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3693 - protein, 150 aa, Unknown
  Description of Unknown: uncultivated organism
  MG1-61 HNH domain
EGFYGEKRRKEIIFEQNKKRKENDLAFEDAKKIGLKGKDAVLKIKLHKEQGGFDIYDGNPIKDNEIDNYEIDHIVPRESGGPDSYINKVLTSRKNNEEKGKRTPYEWLKDKNYWNDYVKRIKDSKTLNDKKKTLLTSSEAVNLAEKYTQL

SEQ ID NO: 3694 - protein, 150 aa, Unknown; identical to SEQ ID NO: 3693
  Description of Unknown: uncultivated organism with predicted taxonomy: Deltaproteobacteria
  MG1-62 HNH domain

SEQ ID NO: 3695 - protein, 160 aa, Unknown
  Description of Unknown: uncultivated organism with predicted taxonomy: Verrucomicrobia bacterium 61-8
  MG1-63 HNH domain
DDKDNSLEGRKRTEAIQQALRENEQRRDKARKALEQCGLPTTDDMVVRWLLLEAQGPACIYTNKPIRCTDLPNLQIEHIVPRALGGPDAFWNWVLSDENANAEKGDRVPYVWFKEEKTDEEWADYKRRVLARAAHLGRRKVDLLLRPDAAELAGEKYTAL

SEQ ID NO: 3696 - protein, 160 aa, Unknown
  Description of Unknown: uncultivated organism
  MG1-64 HNH domain
DDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAQLGRRKADLHLRPDAAELAGEKYTAL

SEQ ID NO: 3697 - protein, 175 aa, Unknown
  Description of Unknown: uncultivated organism with predicted taxonomy: Verrucomicrobia
  MG1-65 HNH domain
EDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETL

SEQ ID NO: 3698 - protein, 163 aa, Unknown
  Description of Unknown: uncultivated organism
  MG1-66 HNH domain
ETLDSKGRKERYKKVQDANRKAKEEAKKNLRELRNNGISIDGENALLKVRLWQEQNGRDLYTGLPIGQTEISICEIDHIIPREMGGPNAMYNFVLTKPECNREKGKRTPYQWLGSDPEKWQMFVDRINSEEYKKLSDRKKELLLKTITDEDELKELVEKYTHL

SEQ ID NO: 3699 - protein, 160 aa, Unknown
  Description of Unknown: uncultivated organism
  MG1-67 HNH domain
DDKDNSLEGRKRTEAIQQALRENEQRRDKARKALEQCGLPTTDDMVVRWLLLEAQGPACIYTNKPIRCTDLPNLQIEHIVPRSFGGPDAFWNWVLCDENANAEKGDRVPYVWFKEEKTDEEWADYKRRVLARAAQLGRRKVDLLLRPDAAELAGEKYTAL

SEQ ID NO: 3700 - protein, 150 aa, Unknown
  Description of Unknown: uncultivated organism with predicted taxonomy: Elusimicrobia bacterium HGW-Elusimicrobia-1
  MG1-68 HNH domain
DGFYGKIKKKKIIAEQNKNRKESDLAFKEAQTLGLKGGESILKIKLYREQGGFDLYDGKTIKDTEIDNYEIDHIVPREDGGPDSYINKVLTSRKNNDDKGKRTPYEWLSKSDNWEEYFERVKKLPKDSKKKKDLLVSANAKELVEKYTQL

SEQ ID NO: 3701 - protein, 168 aa, Unknown
  Description of Unknown: uncultivated organism with predicted taxonomy: Pedosphaera sp. Tous-C6FEB
  MG1-69 HNH domain
EDFMGEEAKRRLQTFQRQREEERKKARSIAAQAGAESALSALKCQLWEAQGGECLNGREVLDQTGQSKARCLYRQTALPLSRLDEYVIDHIVPRARGGPEAMVNYVLTTAETNEAKGDRTPFEWLHGSPDWDAYVARVKARAAALRNKKVQLLTREDAPELVERYTAL

SEQ ID NO: 3702 - protein, 158 aa, Unknown
  Description of Unknown: uncultivated organism with predicted taxonomy: Endomicrobium
  MG1-70 HNH domain
ETLETSKRKDYKKIQKFNLKAKEKAKQILEELRSKGISMQGSNKVLKVRLWQEQGGFDVYTGQPIGETEIDICEIDHIVPREMGGPNARYNMVLTKPECNREKGKRTPYQWLGQDPEEWQKFVERLEREKGFENLPAKKKNLLVATNPEELIERYTHL

SEQ ID NO: 3703 - protein, 175 aa, Unknown; identical to SEQ ID NO: 3697
  Description of Unknown: uncultivated organism
  MG1-71 HNH domain

SEQ ID NO: 3704 - protein, 153 aa, Unknown
  Description of Unknown: uncultivated organism with predicted taxonomy: Deltaproteobacteria
  MG1-72 HNH domain
EDFMGEQAKRELQTFQKRREQARAEAEAEAAKLGLESRSSSLRYELFKAQGGICLYTGRTLSETQLDQYEIDHIVPRSLGGPDAMVNYVLTFPEVNSAKEKGKLTPYALLHGTDGWDAYVARVKARAAALRNKKVQLLTREDAPQLVERYTAL

SEQ ID NO: 3705 - protein, 160 aa, Unknown; identical to SEQ ID NO: 3647
  Description of Unknown: uncultivated organism with predicted taxonomy: Pedosphaera sp. Tous-C6FEB
  MG1-73 HNH domain

SEQ ID NO: 3706 - protein, 175 aa, Unknown; identical to SEQ ID NO: 3697
  Description of Unknown: uncultivated organism
  MG1-74 HNH domain

SEQ ID NO: 3707 - protein, 153 aa, Unknown
  Description of Unknown: uncultivated organism
  MG1-75 HNH domain
DIPRNEKERREKEQEIRKNQGRKEKLFERFNAADSAVGSAYKRVLLFDQQRGLCPYSGGELGDPLSSDLEIDHIFPRKRGGISVRENLVLTFADRNRDKGNLTPREAARKRNGWDWDEIEAATARMKWSRKKREIFEREGAGIPPLANVTRTA

SEQ ID NO: 3708 - protein, 156 aa, Unknown
  Description of Unknown: uncultivated organism
  MG1-76 HNH domain
ELLAGEERKKKYLKLQKENRQKKEKAEKIYQELKNGNVNLKGRSILLKIQLWQEQNGIDPYSGEQIPQTKINLYEIDHIVPREMGGSDAYFNKVLTSPEKNREKAKRTPYQMFKGNISDWKKYLNTIEKITNLSKKKRALLTSENPEELIERYTHL

SEQ ID NO: 3709 - protein, 137 aa, Unknown
  Description of Unknown: uncultivated organism
  MG1-77 HNH domain
EDFMGEQAKRDLQSFQKRREQARAEAEAEAAKLGLGSRSRALRYELFKAQGGICLYTGRPLSETQLDQYEIDHIVPRSLGGPDAMVNYVLTFPEVNSAKEKGKLTPYALLHGTPHWDAYVARVKARAATLRNKKVQL

SEQ ID NO: 3710 - protein, 151 aa, Unknown
  Description of Unknown: uncultivated organism with predicted taxonomy: Verrucomicrobia
  MG1-78 HNH domain
EDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRTPYEWLSQTPGWDAYVERVKERAVTLRNKKVSLLTRPDADTLVDKYTAL

SEQ ID NO: 3711 - protein, 157 aa, Unknown
  Description of Unknown: uncultivated organism
  MG1-79 HNH domain
EIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMA

SEQ ID NO: 3712 - protein, 151 aa, Unknown
  Description of Unknown: uncultivated organism with predicted taxonomy: Verrucomicrobia
  MG1-80 HNH domain
EDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRMPYEWLSQTPGWDAYVERVKERAVTLRNKKVSLLTRPDADTLVDKYTAL

SEQ ID NO: 3713 - protein, 152 aa, Unknown
  Description of Unknown: uncultivated organism
  MG1-81 HNH domain
SLALGEKNKRELLKRNKANRDQRESIRQELASRNASTSRNAILRYRLWKEALSTCPFCGDKITQEQLLRGEADIEHLVPRSVVDCNEFYNLTVGHVRCNRELKGDRTPFQAFGHTEKWPQLRDNAEKCFKGRKLEIFLSDNAEQLIEQKADL

SEQ ID NO: 3714 - protein, 151 aa, Unknown
  Description of Unknown: uncultivated organism
  MG1-82 HNH domain
EDFMGEEAKRRLRSFQRQREAERKRAREETAEAGATEKSAPLKYELLTAQGGLCLYCGQALTLKKLEQYAIDHIVPVGAQGSDALFNKVLAHQECNAAKGKQTPFEWLHGTPGWDAYVARVKARAATLRNKKVQLLTREDAPELVERYTAL

SEQ ID NO: 3715 - protein, 154 aa, Unknown
  Description of Unknown: uncultivated organism
  MG1-83 HNH domain
DIPRNQKEKKEFKDEIKANRSRKTDIIEKKYNLKLDSLSDWQVKQVLLFDQQANDDGEAFSPYTGASLGKNPLAHGLEVEHIYPERRGGISIMDNLVITWRTENQTKGDQTPWEWLGQRATAQLQKMHWNRDKRALFVREESEPPQWDNTTRMA

SEQ ID NO: 3716 - protein, 152 aa, Unknown
  Description of Unknown: uncultivated organism with predicted taxonomy: Coraliomargarita sp. CAG:312
  MG1-84 HNH domain
EDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTAL

SEQ ID NO: 3717 - protein, 152 aa, Unknown; identical to SEQ ID NO: 3692
  Description of Unknown: uncultivated organism with predicted taxonomy: unclassified Verrucomicrobia (miscellaneous)
  MG1-85 HNH domain

SEQ ID NO: 3718 - protein, 152 aa, Unknown
  Description of Unknown: uncultivated organism with predicted taxonomy: Coraliomargarita sp. CAG:312
  MG1-86 HNH domain
EDFMGKQAKKDLSLSMKKRFEEKIDIAKKLDDIGYKGNKMLLKMELLQKQGFACLYTGEALQETDLPVLEIEHIVPRSLGGPDAAYNYVLTSESTNKAKGNQTPYKWLSPDRDKWRAYTERVRARAAELGSKRCRLLLSENAEELINKYTAL

SEQ ID NO: 3719 - protein, 158 aa, Unknown
  Description of Unknown: uncultivated organism with predicted taxonomy: Verrucomicrobia
  MG1-87 HNH domain
DDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTAL

SEQ ID NO: 3720 - protein, 152 aa, Unknown; identical to SEQ ID NO: 3692
  Description of Unknown: uncultivated organism with predicted taxonomy: unclassified Verrucomicrobia (miscellaneous)
  MG1-88 HNH domain

SEQ ID NO: 3721 - protein, 152 aa, Unknown; identical to SEQ ID NO: 3692
  Description of Unknown: uncultivated organism with predicted taxonomy: unclassified Verrucomicrobia (miscellaneous)
  MG1-89 HNH domain

SEQ ID NO: 3722 - protein, 152 aa, Unknown; identical to SEQ ID NO: 3692
  Description of Unknown: uncultivated organism with predicted taxonomy: unclassified Verrucomicrobia (miscellaneous)
  MG1-90 HNH domain

SEQ ID NO: 3723 - protein, 158 aa, Unknown
  Description of Unknown: uncultivated organism
  MG1-91 HNH domain
DDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTAL

SEQ ID NO: 3724 - protein, 152 aa, Unknown; identical to SEQ ID NO: 3641
  Description of Unknown: uncultivated organism with predicted taxonomy: unclassified Verrucomicrobia (miscellaneous)
  MG1-92 HNH domain

SEQ ID NO: 3725 - protein, 152 aa, Unknown; identical to SEQ ID NO: 3692
  Description of Unknown: uncultivated organism with predicted taxonomy: unclassified Verrucomicrobia (miscellaneous)
  MG1-93 HNH domain

SEQ ID NO: 3726 - protein, 158 aa, Unknown
  Description of Unknown: uncultivated organism with predicted taxonomy: unclassified Verrucomicrobia (miscellaneous)
  MG1-94 HNH domain
DDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDRTPFEWLSSDKTKWESYCDRVRSLTQSLGAKRCKLLVSPNAEELMQKYTAL

SEQ ID NO: 3727 - protein, 152 aa, Unknown
  Description of Unknown: uncultivated organism with predicted taxonomy: Coraliomargarita sp. CAG:312
  MG1-95 HNH domain
EDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARATELGSKRCRLLLSENAEELINKYTAL

SEQ ID NO: 3728 - protein, 152 aa, Unknown; identical to SEQ ID NO: 3692
  Description of Unknown: uncultivated organism with predicted taxonomy: unclassified Verrucomicrobia (miscellaneous)
  MG1-96 HNH domain

SEQ ID NO: 3729 - protein, 152 aa, Unknown; identical to SEQ ID NO: 3692
  Description of Unknown: uncultivated organism with predicted taxonomy: unclassified Verrucomicrobia (miscellaneous)
  MG1-97 HNH domain

SEQ ID NO: 3730 - protein, 152 aa, Unknown; identical to SEQ ID NO: 3692
  Description of Unknown: uncultivated organism with predicted taxonomy: unclassified Verrucomicrobia (miscellaneous)
  MG1-98 HNH domain

SEQ ID NO: 3731 - protein, 152 aa, Unknown; identical to SEQ ID NO: 3692
  Description of Unknown: uncultivated organism with predicted taxonomy: unclassified Verrucomicrobia (miscellaneous)
  MG1-99 HNH domain

SEQ ID NO: 3732 - protein, 152 aa, Unknown; identical to SEQ ID NO: 3716
  Description of Unknown: uncultivated organism with predicted taxonomy: Coraliomargarita sp. CAG:312
  MG1-100 HNH domain

SEQ ID NO: 3733 - protein, 152 aa, Unknown
  Description of Unknown: uncultivated organism with predicted taxonomy: unclassified Verrucomicrobia (miscellaneous)
  MG1-101 HNH domain
DDFLGEKAKKEYQKAINERFKEKQELAKEMDEAGYKGAKMLLKLELYKKQGGQCVYTGEALPSSEIASLEIEHIVPRSRGGPDSIYNYVLTRESTNKEKADMTPYEWLSRNADRWNAYVSRVNSLYKSLGGKRCKLLLANNAEELVDKYTAL

SEQ ID NO: 3734 - protein, 152 aa, Unknown
  Description of Unknown: uncultivated organism with predicted taxonomy: unclassified Verrucomicrobia (miscellaneous)
  MG1-102 HNH domain
DDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAAL

SEQ ID NO: 3735 - protein, 152 aa, Unknown; identical to SEQ ID NO: 3692
  Description of Unknown: uncultivated organism with predicted taxonomy: Verrucomicrobia
  MG1-103 HNH domain

SEQ ID NO: 3736 - protein, 152 aa, Unknown; identical to SEQ ID NO: 3716
  Description of Unknown: uncultivated organism with predicted taxonomy: Verrucomicrobia
  MG1-104 HNH domain

SEQ ID NO: 3737 - protein, 152 aa, Unknown; identical to SEQ ID NO: 3692
  Description of Unknown: uncultivated organism
  MG1-105 HNH domain

SEQ ID NO: 3738 - protein, 158 aa, Unknown
  Description of Unknown: uncultivated organism with predicted taxonomy: Verrucomicrobia
  MG1-106 HNH domain
DDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWLSSKGAEWDSYCDRVRELTKNLGAKRCRLLLAPNAAELVEKYTAL

SEQ ID NO: 3739 - protein, 158 aa, Unknown; identical to SEQ ID NO: 3719
  Description of Unknown: uncultivated organism with predicted taxonomy: Verrucomicrobia
  MG1-107 HNH domain

SEQ ID NO: 3740 - protein, 158 aa, Unknown
  Description of Unknown: uncultivated organism with predicted taxonomy: Verrucomicrobia
  MG1-108 HNH domain
DDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTAL

SEQ ID NO: 3741 - protein, 152 aa, Unknown
  Description of Unknown: uncultivated organism with predicted taxonomy: unclassified Verrucomicrobia (miscellaneous)
  MG1-109 HNH domain
DDFMGEKEKKEMRSAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3742 - protein, 158 aa, Unknown
  Description of Unknown: uncultivated organism with predicted taxonomy: Verrucomicrobia
  MG1-110 HNH domain
DDFLGKKAKSDLNKAIKTRFDEKKKLAEDLDSKREEFGFKYASKKMLLKFELYKKQGGECVYTGKALPLSELESLEIEHIVPRSRGGPDAMYNYVLTDEKTNKEKGDRTPFEWRSTMGAEWESYCERVRKLTKELGAKRCKLLLSPNAAELVEKYTAL

SEQ ID NO: 3743 - protein, 152 aa, Unknown; identical to SEQ ID NO: 3716
  Description of Unknown: uncultivated organism with predicted taxonomy: Coraliomargarita sp. CAG:312
  MG1-111 HNH domain

SEQ ID NO: 3744 - protein, 152 aa, Unknown; identical to SEQ ID NO: 3692
  Description of Unknown: uncultivated organism with predicted taxonomy: unclassified Verrucomicrobia (miscellaneous)
  MG1-112 HNH domain

SEQ ID NO: 3745 - protein, 152 aa, Unknown
  Description of Unknown: uncultivated organism with predicted taxonomy: Verrucomicrobia
  MG1-113 HNH domain
EDFMGKEQKKRMQIGMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRIKARAGQLGRKRCELLLEKNAEELVEKYTAL

SEQ ID NO: 3746 - protein, 152 aa, Unknown; identical to SEQ ID NO: 3641
  Description of Unknown: uncultivated organism with predicted taxonomy: unclassified Verrucomicrobia (miscellaneous)
  MG1-114 HNH domain

SEQ ID NO: 3747 - protein, 152 aa, Unknown; identical to SEQ ID NO: 3641
  Description of Unknown: uncultivated organism with predicted taxonomy: unclassified Verrucomicrobia (miscellaneous)
  MG1-115 HNH domain

SEQ ID NO: 3748 - protein, 158 aa, Unknown; identical to SEQ ID NO: 3719
  Description of Unknown: uncultivated organism with predicted taxonomy: Verrucomicrobia
  MG1-116 HNH domain

SEQ ID NO: 3749 - protein, 152 aa, Unknown; identical to SEQ ID NO: 3716
  Description of Unknown: uncultivated organism with predicted taxonomy: Coraliomargarita sp. CAG:312
  MG1-117 HNH domain

SEQ ID NO: 3750 - protein, 152 aa, Unknown; identical to SEQ ID NO: 3692
  Description of Unknown: uncultivated organism with predicted taxonomy: unclassified Verrucomicrobia (miscellaneous)
  MG1-118 HNH domain

SEQ ID NO: 3751 - protein, 152 aa, Unknown; identical to SEQ ID NO: 3692
  Description of Unknown: uncultivated organism with predicted taxonomy: unclassified Verrucomicrobia (miscellaneous)
  MG1-119 HNH domain

SEQ ID NO: 3752 - protein, 152 aa, Unknown
  Description of Unknown: uncultivated organism with predicted taxonomy: unclassified Verrucomicrobia (miscellaneous)
  MG1-120 HNH domain
EDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTAL

SEQ ID NO: 3753 - protein, 152 aa, Unknown; identical to SEQ ID NO: 3692
  Description of Unknown: uncultivated organism with predicted taxonomy: unclassified Verrucomicrobia (miscellaneous)
  MG1-121 HNH domain

SEQ ID NO: 3754 - protein, 152 aa, Unknown; identical to SEQ ID NO: 3692
  Description of Unknown: uncultivated organism with predicted taxonomy: unclassified Verrucomicrobia (miscellaneous)
  MG1-122 HNH domain

SEQ ID NO: 3755 - protein, 152 aa, Unknown; identical to SEQ ID NO: 3692
  Description of Unknown: uncultivated organism with predicted taxonomy: unclassified Verrucomicrobia (miscellaneous)
  MG1-123 HNH domain

SEQ ID NO: 3756 - protein, 158 aa, Unknown; identical to SEQ ID NO: 3719
  Description of Unknown: uncultivated organism with predicted taxonomy: Verrucomicrobia
  MG1-124 HNH domain

SEQ ID NO: 3757 - protein, 152 aa, Unknown; identical to SEQ ID NO: 3716
  Description of Unknown: uncultivated organism with predicted taxonomy: Verrucomicrobia
  MG1-125 HNH domain

SEQ ID NO: 3758 - protein, 152 aa, Unknown; identical to SEQ ID NO: 3692
  Description of Unknown: uncultivated organism with predicted taxonomy: unclassified Verrucomicrobia (miscellaneous)
  MG1-126 HNH domain

SEQ ID NO: 3759 - protein, 158 aa, Unknown; identical to SEQ ID NO: 3738
  Description of Unknown: uncultivated organism with predicted taxonomy: Verrucomicrobia
  MG1-127 HNH domain

SEQ ID NO: 3760 - protein, 152 aa, Unknown; identical to SEQ ID NO: 3692
  Description of Unknown: uncultivated organism with predicted taxonomy: unclassified Verrucomicrobia (miscellaneous)
  MG1-128 HNH domain

SEQ ID NO: 3761 - protein, 158 aa, Unknown; identical to SEQ ID NO: 3719
  Description of Unknown: uncultivated organism with predicted taxonomy: Verrucomicrobia
  MG1-129 HNH domain

SEQ ID NO: 3762 - protein, 152 aa, Unknown; identical to SEQ ID NO: 3692
  Description of Unknown: uncultivated organism with predicted taxonomy: unclassified Verrucomicrobia (miscellaneous)
  MG1-130 HNH domain

SEQ ID NO: 3763 - protein, 152 aa, Unknown; identical to SEQ ID NO: 3641
  Description of Unknown: uncultivated organism with predicted taxonomy: unclassified Verrucomicrobia (miscellaneous)
  MG1-131 HNH domain

SEQ ID NO: 3764 - protein, 152 aa, Unknown
  Description of Unknown: uncultivated organism with predicted taxonomy: unclassified Verrucomicrobia (miscellaneous)
  MG1-132 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTAL

SEQ ID NO: 3765 - protein, 152 aa, Unknown; identical to SEQ ID NO: 3716
  Description of Unknown: uncultivated organism with predicted taxonomy: Coraliomargarita sp. CAG:312
  MG1-133 HNH domain

SEQ ID NO: 3766 - protein, 152 aa, Unknown; identical to SEQ ID NO: 3641
  Description of Unknown: uncultivated organism with predicted taxonomy: unclassified Verrucomicrobia (miscellaneous)
  MG1-134 HNH domain

SEQ ID NO: 3767 - protein, 152 aa, Unknown; identical to SEQ ID NO: 3692
  Description of Unknown: uncultivated organism with predicted taxonomy: unclassified Verrucomicrobia (miscellaneous)
  MG1-135 HNH domain

SEQ ID NO: 3768 - protein, 158 aa, Unknown; identical to SEQ ID NO: 3719
  Description of Unknown: uncultivated organism with predicted taxonomy: Verrucomicrobia
  MG1-136 HNH domain

SEQ ID NO: 3769 - protein, 152 aa, Unknown; identical to SEQ ID NO: 3692
  Description of Unknown: uncultivated organism with predicted taxonomy: unclassified Verrucomicrobia (miscellaneous)
  MG1-137 HNH domain

SEQ ID NO: 3770 - protein, 152 aa, Unknown; identical to SEQ ID NO: 3692
  Description of Unknown: uncultivated organism with predicted taxonomy: unclassified Verrucomicrobia (miscellaneous)
  MG1-138 HNH domain

SEQ ID NO: 3771 - protein, 152 aa, Unknown; identical to SEQ ID NO: 3692
  Description of Unknown: uncultivated organism with predicted taxonomy: unclassified Verrucomicrobia (miscellaneous)
  MG1-139 HNH domain

SEQ ID NO: 3772 - protein, 152 aa, Unknown; identical to SEQ ID NO: 3692
  Description of Unknown: uncultivated organism with predicted taxonomy: unclassified Verrucomicrobia (miscellaneous)
  MG1-140 HNH domain

SEQ ID NO: 3773 - protein, 158 aa, Unknown
  Description of Unknown: uncultivated organism with predicted taxonomy: Verrucomicrobia
  MG1-141 HNH domain
DDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTAL

SEQ ID NO: 3774 - protein, 152 aa, Unknown
  Description of Unknown: uncultivated organism with predicted taxonomy: unclassified Verrucomicrobia (miscellaneous)
  MG1-142 HNH domain
EDFMGKEQKKRMQIEMKKRASEKMLIAKKLDEAGYKGGNLLLKMELFEKQGGVCLYTGEPLLPSELGILEIEHIVPRSRGGPDAQYNYVLTREKTNKEKADRTPFEWLSSDPVRWAGYSDRVKARAGQLGRKRCELLLEKNAEELVEKYTAL

SEQ ID NO: 3775 - protein, 152 aa, Unknown
  Description of Unknown: uncultivated organism with predicted taxonomy: Verrucomicrobia bacterium
  MG1-143 HNH domain
EDFMGKEQKKRMQIEMKKRASEKMLIAKKLDEAGYKGGNLLMKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTAL

SEQ ID NO: 3776 - protein, 152 aa, Unknown; identical to SEQ ID NO: 3641
  Description of Unknown: uncultivated organism with predicted taxonomy: unclassified Verrucomicrobia (miscellaneous)
  MG1-144 HNH domain

SEQ ID NO: 3777 - protein, 158 aa, Unknown
  Description of Unknown: uncultivated organism with predicted taxonomy: Verrucomicrobia
  MG1-145 HNH domain
DDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLSPNAAELVEKYTAL

SEQ ID NO: 3778 - protein, 152 aa, Unknown; identical to SEQ ID NO: 3692
  Description of Unknown: uncultivated organism with predicted taxonomy: unclassified Verrucomicrobia (miscellaneous)
  MG1-147 HNH domain

SEQ ID NO: 3779 - protein, 152 aa, Unknown; identical to SEQ ID NO: 3692
  Description of Unknown: uncultivated organism with predicted taxonomy: unclassified Verrucomicrobia (miscellaneous)
  MG1-148 HNH domain

SEQ ID NO: 3780 - protein, 152 aa, Unknown
  Description of Unknown: uncultivated organism with predicted taxonomy: unclassified Verrucomicrobia (miscellaneous)
  MG1-149 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVTACAKALGKKRCRLLLEKDAEELVEKYTAL

SEQ ID NO: 3781 - protein, 152 aa, Unknown; identical to SEQ ID NO: 3716
  Description of Unknown: uncultivated organism with predicted taxonomy: Coraliomargarita sp. CAG:312
  MG1-150 HNH domain

SEQ ID NO: 3782 - protein, 152 aa, Unknown
  Description of Unknown: uncultivated organism with predicted taxonomy: Verrucomicrobia
  MG1-151 HNH domain
EDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTAL

SEQ ID NO: 3783 - protein, 158 aa, Unknown; identical to SEQ ID NO: 3723
  Description of Unknown: uncultivated organism
  MG1-152 HNH domain

SEQ ID NO: 3784 - protein, 152 aa, Unknown; identical to SEQ ID NO: 3692
  Description of Unknown: uncultivated organism with predicted taxonomy: unclassified Verrucomicrobia (miscellaneous)
  MG1-153 HNH domain

SEQ ID NO: 3785 - protein, 158 aa, Unknown
  Description of Unknown: uncultivated organism with predicted taxonomy: Verrucomicrobia
  MG1-154 HNH domain
DDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPFEWRSTMGAEWESYCERVRKLTKELGAKRCKLLLSPNAAELVEKYTAL

SEQ ID NO: 3786 - protein, 158 aa, Unknown
  Description of Unknown: uncultivated organism with predicted taxonomy: Verrucomicrobia
  MG1-155 HNH domain
DDFLGKKAKADLSRAINDRAKERKKYAEELDSQREIFGSKYASKKMLLKYELYSKQKGVCVYTGNALGFSNLEQLEVEHIVPRSRGGPDALYNYVLTDEKTNKEKGDRTPFEWLSSKGLEWESYCQRVRELTKEFGAKRCRLLLSPNAEELVEKYTAL

SEQ ID NO: 3787 - protein, 152 aa, Unknown; identical to SEQ ID NO: 3716
  Description of Unknown: uncultivated organism with predicted taxonomy: Coraliomargarita sp. CAG:312
  MG1-156 HNH domain

SEQ ID NO: 3788 - protein, 152 aa, Unknown
  Description of Unknown: uncultivated organism with predicted taxonomy: Verrucomicrobia
  MG1-157 HNH domain
DDFLGEKAKKEYQKAINERFKEKQELAKEMDEAGYKGAKMLLKLELYKKQGGQCVYTGEALPSSEIASLEIEHIVPRSRGGPDSIYNYVLTRERTNKEKADRTPYEWLSRDQQRWNAYVSRVNSLYKSLGGKRCKLLLANNAEELVDKYTAL

SEQ ID NO: 3789 - protein, 152 aa, Unknown
  Description of Unknown: uncultivated organism with predicted taxonomy: unclassified Verrucomicrobia (miscellaneous)
  MG1-158 HNH domain
EDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVTARAGQLGRKRCELLLEKNAEELVEKYTAL

SEQ ID NO: 3790 - protein, 152 aa, Unknown
  Description of Unknown: uncultivated organism with predicted taxonomy: Coraliomargarita sp. CAG:312
  MG1-159 HNH domain
DDFIGKEKKKELNIAIKKRYSEKLKIAEKLDEIGFKGSKMLMKLELFQKQGGICLYTREPLLPTEIPSLEIEHIVPRSRGGPDSAYNFVLTREATNKEKANRTPFEWLSGDSQKWVSYSDRVMSRSKELGKKRCQLLLKENAEELVEKYTAL

SEQ ID NO: 3791 - protein, 152 aa, Unknown; identical to SEQ ID NO: 3692
  Description of Unknown: uncultivated organism with predicted taxonomy: unclassified Verrucomicrobia (miscellaneous)
  MG1-160 HNH domain

SEQ ID NO: 3792 - protein, 158 aa, Unknown; identical to SEQ ID NO: 3723
  Description of Unknown: uncultivated organism with predicted taxonomy: Verrucomicrobia
  MG1-161 HNH domain

SEQ ID NO: 3793 - protein, 152 aa, Unknown; identical to SEQ ID NO: 3716
  Description of Unknown: uncultivated organism with predicted taxonomy: Coraliomargarita sp. CAG:312
  MG1-162 HNH domain

SEQ ID NO: 3794 - protein, 152 aa, Unknown
  Description of Unknown: uncultivated organism with predicted taxonomy: unclassified Verrucomicrobia (miscellaneous)
  MG1-163 HNH domain
EDFMGKEQKKRMQIEMKKRASEKMLIAKKLDEAGYKGGNLLLKMELLEKQGGVCLYTGEPLLPSELGVLEIEHIVPRSRGGPDAQYNYVLPREKTNKEKADRTPFEWLSSDPVKWAGYSDRVKARAGQLGRKRCELLLEKNAEELVEKYTAL

SEQ ID NO: 3795 - protein, 158 aa, Unknown
  Description of Unknown: uncultivated organism with predicted taxonomy: Verrucomicrobia
  MG1-164 HNH domain
DDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGERTPFEWLSSDKTKWESYCDRVRSLTQSLGAKRCKLLVSPNAEELMQKYTAL

SEQ ID NO: 3796 - protein, 152 aa, Unknown; identical to SEQ ID NO: 3692
  Description of Unknown: uncultivated organism with predicted taxonomy: unclassified Verrucomicrobia (miscellaneous)
  MG1-165 HNH domain

SEQ ID NO: 3797 - protein, 152 aa, Unknown
  Description of Unknown: uncultivated organism with predicted taxonomy: unclassified Verrucomicrobia (miscellaneous)
  MG1-166 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKGLGKKRCRLLLEKDAEELVEKYTAL

SEQ ID NO: 3798 - protein, 152 aa, Unknown; identical to SEQ ID NO: 3692
  Description of Unknown: uncultivated organism with predicted taxonomy: unclassified Verrucomicrobia (miscellaneous)
  MG1-167 HNH domain

SEQ ID NO: 3799 - protein, 158 aa, Unknown; identical to SEQ ID NO: 3723
  Description of Unknown: uncultivated organism with predicted taxonomy: Verrucomicrobia
  MG1-168 HNH domain

SEQ ID NO: 3800 - protein, 152 aa, Unknown; identical to SEQ ID NO: 3692
  Description of Unknown: uncultivated organism with predicted taxonomy: unclassified Verrucomicrobia (miscellaneous)
  MG1-169 HNH domain

SEQ ID NO: 3801 - protein, 152 aa, Unknown; identical to SEQ ID NO: 3692
  Description of Unknown: uncultivated organism with predicted taxonomy: unclassified Verrucomicrobia (miscellaneous)
  MG1-170 HNH domain

SEQ ID NO: 3802 - protein, 152 aa, Unknown
  Description of Unknown: uncultivated organism with predicted taxonomy: unclassified Verrucomicrobia (miscellaneous)
  MG1-171 HNH domain
DDFMGEKEKKEMRIAMKKRAEEKMRIAKDLDEHGFKGDNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3803 - protein, 158 aa, Unknown; identical to SEQ ID NO: 3719
  Description of Unknown: uncultivated organism with predicted taxonomy: Verrucomicrobia
  MG1-172 HNH domain

SEQ ID NO: 3804 - protein, 152 aa, Unknown
  Description of Unknown: uncultivated organism with predicted taxonomy: unclassified Verrucomicrobia (miscellaneous)
  MG1-173 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACTKALGKKRCRLLLEKDAEELVEKYTAL

SEQ ID NO: 3805 - protein, 152 aa, Unknown; identical to SEQ ID NO: 3692
  Description of Unknown: uncultivated organism with predicted taxonomy: unclassified Verrucomicrobia (miscellaneous)
  MG1-174 HNH domain

SEQ ID NO: 3806 - protein, 158 aa, Unknown; identical to SEQ ID NO: 3719
  Description of Unknown: uncultivated organism with predicted taxonomy: Coraliomargarita sp. CAG:312
  MG1-175 HNH domain

SEQ ID NO: 3807 - protein, 152 aa, Unknown; identical to SEQ ID NO: 3734
  Description of Unknown: uncultivated organism with predicted taxonomy: unclassified Verrucomicrobia (miscellaneous)
  MG1-176 HNH domain

SEQ ID NO: 3808 - protein, 158 aa, Unknown; identical to SEQ ID NO: 3777
  Description of Unknown: uncultivated organism with predicted taxonomy: Verrucomicrobia
  MG1-177 HNH domain

SEQ ID NO: 3809 - protein, 152 aa, Unknown; identical to SEQ ID NO: 3790
  Description of Unknown: uncultivated organism with predicted taxonomy: Coraliomargarita sp. CAG:312
  MG1-178 HNH domain

SEQ ID NO: 3810 - protein, 158 aa, Unknown; identical to SEQ ID NO: 3773
  Description of Unknown: uncultivated organism with predicted taxonomy: Coraliomargarita sp. CAG:312
  MG1-179 HNH domain

SEQ ID NO: 3811 - protein, 152 aa, Unknown; identical to SEQ ID NO: 3764
  Description of Unknown: uncultivated organism with predicted taxonomy: unclassified Verrucomicrobia (miscellaneous)
  MG1-180 HNH domain

SEQ ID NO: 3812 - protein, 152 aa, Unknown; identical to SEQ ID NO: 3641
  Description of Unknown: uncultivated organism with predicted taxonomy: unclassified Verrucomicrobia (miscellaneous)
  MG1-181 HNH domain

SEQ ID NO: 3813 - protein, 152 aa, Unknown; identical to SEQ ID NO: 3641
  Description of Unknown: uncultivated organism with predicted taxonomy: unclassified Verrucomicrobia (miscellaneous)
  MG1-182 HNH domain

SEQ ID NO: 3814 - protein, 152 aa, Unknown; identical to SEQ ID NO: 3727
  Description of Unknown: uncultivated organism with predicted taxonomy: Coraliomargarita sp. CAG:312
  MG1-183 HNH domain

SEQ ID NO: 3815 - protein, 152 aa, Unknown; identical to SEQ ID NO: 3692
  Description of Unknown: uncultivated organism with predicted taxonomy: unclassified Verrucomicrobia (miscellaneous)
  MG1-184 HNH domain

SEQ ID NO: 3816 - protein, 152 aa, Unknown; identical to SEQ ID NO: 3716
  Description of Unknown: uncultivated organism with predicted taxonomy: Coraliomargarita sp. CAG:312
  MG1-185 HNH domain

SEQ ID NO: 3817 - protein, 152 aa, Unknown; identical to SEQ ID NO: 3692
  Description of Unknown: uncultivated organism with predicted taxonomy: unclassified Verrucomicrobia (miscellaneous)
  MG1-186 HNH domain

SEQ ID NO: 3818 - protein, 158 aa, Unknown; identical to SEQ ID NO: 3719
  Description of Unknown: uncultivated organism with predicted taxonomy: Verrucomicrobia
  MG1-187 HNH domain

SEQ ID NO: 3819 - protein, 152 aa, Unknown; identical to SEQ ID NO: 3716
  Description of Unknown: uncultivated organism with predicted taxonomy: Verrucomicrobia
  MG1-188 HNH domain

SEQ ID NO: 3820 - protein, 158 aa, Unknown; identical to SEQ ID NO: 3719
  Description of Unknown: uncultivated organism with predicted taxonomy: Verrucomicrobia
  MG1-189 HNH domain

SEQ ID NO: 3821 - protein, 152 aa, Unknown; identical to SEQ ID NO: 3692
  Description of Unknown: uncultivated organism with predicted taxonomy: unclassified Verrucomicrobia (miscellaneous)
  MG1-190 HNH domain

SEQ ID NO: 3822 - protein, 152 aa, Unknown; identical to SEQ ID NO: 3692
  Description of Unknown: uncultivated organism with predicted taxonomy: unclassified Verrucomicrobia (miscellaneous)
  MG1-191 HNH domain

SEQ ID NO: 3823 - protein, 152 aa, Unknown
  Description of Unknown: uncultivated organism with predicted taxonomy: unclassified Verrucomicrobia (miscellaneous)
  MG1-192 HNH domain
DDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTAL

SEQ ID NO: 3824 - protein, 158 aa, Unknown; identical to SEQ ID NO: 3785
  Description of Unknown: uncultivated organism with predicted taxonomy: Verrucomicrobia
  MG1-193 HNH domain

SEQ ID NO: 3825 - protein, 152 aa, Unknown; identical to SEQ ID NO: 3764
  Description of Unknown: uncultivated organism with predicted taxonomy: unclassified Verrucomicrobia (miscellaneous)
  MG1-194 HNH domain

SEQ ID NO: 3826 - protein, 152 aa, Unknown; identical to SEQ ID NO: 3692
  Description of Unknown: uncultivated organism with predicted taxonomy: unclassified Verrucomicrobia (miscellaneous)
  MG1-195 HNH domain

SEQ ID NO: 3827 - protein, 152 aa, Unknown; identical to SEQ ID NO: 3782
  Description of Unknown: uncultivated organism with predicted taxonomy: Verrucomicrobia
  MG1-196 HNH domain

SEQ ID NO: 3828 - protein, 152 aa, Unknown; identical to SEQ ID NO: 3692
  Description of Unknown: uncultivated organism with predicted taxonomy: unclassified Verrucomicrobia (miscellaneous)
  MG1-197 HNH domain

SEQ ID NO: 3829 - protein, 152 aa, Unknown
  Description of Unknown: uncultivated organism with predicted taxonomy: unclassified Verrucomicrobia (miscellaneous)
  MG1-198 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTAL

SEQ ID NO: 3830 - protein, 152 aa, Unknown; identical to SEQ ID NO: 3829
  Description of Unknown: uncultivated organism with predicted taxonomy: unclassified Verrucomicrobia (miscellaneous)
  MG1-199 HNH domain

SEQ ID NO: 3831 - protein, 158 aa, Unknown
  Description of Unknown: uncultivated organism
  MG1-200 HNH domain
DDFLGKKAKSDLNKAIKTRFDEKKKLAEDLDSKREEFGFKYASKKMLLKFELYKKQGGKCVYTGNALPLSELESLEIEHIVPRSRGGPDAMYNYVLTDEKTNKEKGDRTPFEWLSTMGAEWESYCERVRKLTKELGAKRCKLLLSPNAAELVEKYTAL

SEQ ID NO: 3832 - protein, 158 aa, Unknown; identical to SEQ ID NO: 3719
  Description of Unknown: uncultivated organism with predicted taxonomy: Verrucomicrobia
  MG1-201 HNH domain

SEQ ID NO: 3833 - protein, 158 aa, Unknown
  Description of Unknown: uncultivated organism with predicted taxonomy: Coraliomargarita sp. CAG:312
  MG1-202 HNH domain
DDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLAPNAAELVEKYTAL

SEQ ID NO: 3834 - protein, 152 aa, Unknown; identical to SEQ ID NO: 3716
  Description of Unknown: uncultivated organism with predicted taxonomy: Coraliomargarita sp. CAG:312
  MG1-203 HNH domain

SEQ ID NO: 3835 - protein, 158 aa, Unknown; identical to SEQ ID NO: 3742
  Description of Unknown: uncultivated organism with predicted taxonomy: Verrucomicrobia
  MG1-204 HNH domain

SEQ ID NO: 3836 - protein, 158 aa, Unknown; identical to SEQ ID NO: 3719
  Description of Unknown: uncultivated organism with predicted taxonomy: Coraliomargarita sp. CAG:312
  MG1-205 HNH domain

SEQ ID NO: 3837 - protein, 152 aa, Unknown; identical to SEQ ID NO: 3716
  Description of Unknown: uncultivated organism with predicted taxonomy: Coraliomargarita sp. CAG:312
  MG1-206 HNH domain

SEQ ID NO: 3838 - protein, 152 aa, Unknown; identical to SEQ ID NO: 3752
  Description of Unknown: uncultivated organism with predicted taxonomy: unclassified Verrucomicrobia (miscellaneous)
  MG1-207 HNH domain

SEQ ID NO: 3839 - protein, 152 aa, Unknown; identical to SEQ ID NO: 3692
  Description of Unknown: uncultivated organism with predicted taxonomy: unclassified Verrucomicrobia (miscellaneous)
  MG1-208 HNH domain

SEQ ID NO: 3840 - protein, 152 aa, Unknown; identical to SEQ ID NO: 3741
  Description of Unknown: uncultivated organism with predicted taxonomy: unclassified Verrucomicrobia (miscellaneous)
  MG1-209 HNH domain

SEQ ID NO: 3841 - protein, 152 aa, Unknown; identical to SEQ ID NO: 3692
  Description of Unknown: uncultivated organism with predicted taxonomy: unclassified Verrucomicrobia (miscellaneous)
  MG1-210 HNH domain

SEQ ID NO: 3842 - protein, 152 aa, Unknown; identical to SEQ ID NO: 3718
  Description of Unknown: uncultivated organism with predicted taxonomy: Coraliomargarita sp. CAG:312
  MG1-211 HNH domain

SEQ ID NO: 3843 - protein, 152 aa, Unknown; identical to SEQ ID NO: 3692
  Description of Unknown: uncultivated organism with predicted taxonomy: unclassified Verrucomicrobia (miscellaneous)
  MG1-212 HNH domain

SEQ ID NO: 3844 - protein, 152 aa, Unknown; identical to SEQ ID NO: 3692
  Description of Unknown: uncultivated organism with predicted taxonomy: unclassified Verrucomicrobia (miscellaneous)
  MG1-213 HNH domain

SEQ ID NO: 3845 - protein, 152 aa, Unknown; identical to SEQ ID NO: 3692
  Description of Unknown: uncultivated organism with predicted taxonomy: unclassified Verrucomicrobia (miscellaneous)
  MG1-214 HNH domain

SEQ ID NO: 3846 - protein, 152 aa, Unknown; identical to SEQ ID NO: 3692
  Description of Unknown: uncultivated organism with predicted taxonomy: unclassified Verrucomicrobia (miscellaneous)
  MG1-215 HNH domain

SEQ ID NO: 3847 - protein, 152 aa, Unknown
  Description of Unknown: uncultivated organism with predicted taxonomy: unclassified Verrucomicrobia (miscellaneous)
  MG1-216 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVIIREKTNKLKGDKTPYEWLSSDAKEWASYTDRVNACAKALGKKRCRLLLEKDAEELVEKYTAL

SEQ ID NO: 3848 - protein, 152 aa, Unknown; identical to SEQ ID NO: 3716
  Description of Unknown: uncultivated organism with predicted taxonomy: Coraliomargarita sp. CAG:312
  MG1-217 HNH domain

SEQ ID NO: 3849 - protein, 152 aa, Unknown; identical to SEQ ID NO: 3692
  Description of Unknown: uncultivated organism with predicted taxonomy: unclassified Verrucomicrobia (miscellaneous)
  MG1-218 HNH domain

SEQ ID NO: 3850 - protein, 152 aa, Unknown; identical to SEQ ID NO: 3692
  Description of Unknown: uncultivated organism with predicted taxonomy: unclassified Verrucomicrobia (miscellaneous)
  MG1-219 HNH domain

SEQ ID NO: 3851 - protein, 152 aa, Unknown
  Description of Unknown: uncultivated organism with predicted taxonomy: unclassified Verrucomicrobia (miscellaneous)
  MG1-220 HNH domain
DDFMGEKEKKEMRIAMKKRAEGKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCHLLLEKDAEELVEKYTAL

SEQ ID NO: 3852 - protein, 152 aa, Unknown; identical to SEQ ID NO: 3692
  Description of Unknown: uncultivated organism with predicted taxonomy: unclassified Verrucomicrobia (miscellaneous)
  MG1-221 HNH domain

SEQ ID NO: 3853 - protein, 152 aa, Unknown; identical to SEQ ID NO: 3692
  Description of Unknown: uncultivated organism with predicted taxonomy: unclassified Verrucomicrobia (miscellaneous)
  MG1-222 HNH domain

SEQ ID NO: 3854 - protein, 152 aa, Unknown; identical to SEQ ID NO: 3692
  Description of Unknown: uncultivated organism with predicted taxonomy: unclassified Verrucomicrobia (miscellaneous)
  MG1-223 HNH domain

SEQ ID NO: 3855 - protein, 152 aa, Unknown; identical to SEQ ID NO: 3641
  Description of Unknown: uncultivated organism with predicted taxonomy: unclassified Verrucomicrobia (miscellaneous)
  MG1-224 HNH domain

SEQ ID NO: 3856 - protein, 152 aa, Unknown; identical to SEQ ID NO: 3716
  Description of Unknown: uncultivated organism with predicted taxonomy: Coraliomargarita sp. CAG:312
  MG1-225 HNH domain

SEQ ID NO: 3857 - protein, 152 aa, Unknown; identical to SEQ ID NO: 3716
  Description of Unknown: uncultivated organism with predicted taxonomy: Coraliomargarita sp. CAG:312
  MG1-226 HNH domain

SEQ ID NO: 3858 - protein, 152 aa, Unknown
  Description of Unknown: uncultivated organism with predicted taxonomy: Coraliomargarita sp. CAG:312
  MG1-227 HNH domain
EDFMGKQAKKDLSLYMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTAL

SEQ ID NO: 3859 - protein, 152 aa, Unknown; identical to SEQ ID NO: 3692
  Description of Unknown: uncultivated organism with predicted taxonomy: unclassified Verrucomicrobia (miscellaneous)
  MG1-228 HNH domain

SEQ ID NO: 3860 - protein, 152 aa, Unknown; identical to SEQ ID NO: 3692
  Description of Unknown: uncultivated organism with predicted taxonomy: Verrucomicrobia
  MG1-229 HNH domain

SEQ ID NO: 3861 - protein, 152 aa, Unknown
  Description of Unknown: uncultivated organism with predicted taxonomy: Verrucomicrobia
  MG1-230 HNH domain
DDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTTL

SEQ ID NO: 3862 - protein, 152 aa, Unknown; identical to SEQ ID NO: 3692
  Description of Unknown: uncultivated organism with predicted taxonomy: unclassified Verrucomicrobia (miscellaneous)
  MG1-231 HNH domain

SEQ ID NO: 3863 - protein, 158 aa, Unknown; identical to SEQ ID NO: 3719
  Description of Unknown: uncultivated organism with predicted taxonomy: Verrucomicrobia
  MG1-232 HNH domain

SEQ ID NO: 3864 - protein, 152 aa, Unknown; identical to SEQ ID NO: 3745
  Description of Unknown: uncultivated organism
  MG1-233 HNH domain

SEQ ID NO: 3865 - protein, 152 aa, Unknown; identical to SEQ ID NO: 3692
  Description of Unknown: uncultivated organism with predicted taxonomy: unclassified Verrucomicrobia (miscellaneous)
  MG1-234 HNH domain

SEQ ID NO: 3866 - protein, 152 aa, Unknown; identical to SEQ ID NO: 3692
  Description of Unknown: uncultivated organism with predicted taxonomy: unclassified Verrucomicrobia (miscellaneous)
  MG1-236 HNH domain

SEQ ID NO: 3867 - protein, 152 aa, Unknown; identical to SEQ ID NO: 3692
  Description of Unknown: uncultivated organism with predicted taxonomy: Verrucomicrobia
  MG1-237 HNH domain

SEQ ID NO: 3868 - protein, 152 aa, Unknown; identical to SEQ ID NO: 3716
  Description of Unknown: uncultivated organism with predicted taxonomy: Coraliomargarita sp. CAG:312
  MG1-238 HNH domain

SEQ ID NO: 3869 - protein, 152 aa, Unknown; identical to SEQ ID NO: 3641
  Description of Unknown: uncultivated organism with predicted taxonomy: unclassified Verrucomicrobia (miscellaneous)
  MG1-239 HNH domain

SEQ ID NO: 3870 - protein, 152 aa, Unknown; identical to SEQ ID NO: 3692
  Description of Unknown: uncultivated organism with predicted taxonomy: unclassified Verrucomicrobia (miscellaneous)
  MG1-240 HNH domain

SEQ ID NO: 3871 - protein, 152 aa, Unknown; identical to SEQ ID NO: 3716
  Description of Unknown: uncultivated organism with predicted taxonomy: Verrucomicrobia
  MG1-241 HNH domain

SEQ ID NO: 3872 - protein, 152 aa, Unknown; identical to SEQ ID NO: 3716
  Description of Unknown: uncultivated organism with predicted taxonomy: Coraliomargarita sp. CAG:312
  MG1-242 HNH domain

SEQ ID NO: 3873 - protein, 158 aa, Unknown; identical to SEQ ID NO: 3786
  Description of Unknown: uncultivated organism with predicted taxonomy: Verrucomicrobia
  MG1-243 HNH domain

SEQ ID NO: 3874 - protein, 152 aa, Unknown; identical to SEQ ID NO: 3692
  Description of Unknown: uncultivated organism with predicted taxonomy: unclassified Verrucomicrobia (miscellaneous)
  MG1-244 HNH domain

SEQ ID NO: 3875 - protein, 152 aa, Unknown; identical to SEQ ID NO: 3716
  Description of Unknown: uncultivated organism with predicted taxonomy: Coraliomargarita sp. CAG:312
  MG1-245 HNH domain

SEQ ID NO: 3876 - protein, 152 aa, Unknown; identical to SEQ ID NO: 3752
  Description of Unknown: uncultivated organism with predicted taxonomy: unclassified Verrucomicrobia (miscellaneous)
  MG1-246 HNH domain

SEQ ID NO: 3877 - protein, 152 aa, Unknown; identical to SEQ ID NO: 3716
  Description of Unknown: uncultivated organism with predicted taxonomy: Coraliomargarita sp. CAG:312
  MG1-247 HNH domain

SEQ ID NO: 3878 - protein, 152 aa, Unknown; identical to SEQ ID NO: 3782
  Description of Unknown: uncultivated organism with predicted taxonomy: unclassified Verrucomicrobia (miscellaneous)
  MG1-248 HNH domain

SEQ ID NO: 3879 - protein, 152 aa, Unknown; identical to SEQ ID NO: 3692
  Description of Unknown: uncultivated organism with predicted taxonomy: unclassified Verrucomicrobia (miscellaneous)
  MG1-249 HNH domain

SEQ ID NO: 3880 - protein, 152 aa, Unknown; identical to SEQ ID NO: 3716
  Description of Unknown: uncultivated organism with predicted taxonomy: Coraliomargarita sp. CAG:312
  MG1-250 HNH domain

SEQ ID NO: 3881 - protein, 152 aa, Unknown; identical to SEQ ID NO: 3716
  Description of Unknown: uncultivated organism with predicted taxonomy: Coraliomargarita sp. CAG:312
  MG1-251 HNH domain

SEQ ID NO: 3882 - protein, 152 aa, Unknown; identical to SEQ ID NO: 3774
  Description of Unknown: uncultivated organism with predicted taxonomy: unclassified Verrucomicrobia (miscellaneous)
  MG1-252 HNH domain

SEQ ID NO: 3883 - protein, 152 aa, Unknown; identical to SEQ ID NO: 3692
  Description of Unknown: uncultivated organism with predicted taxonomy: unclassified Verrucomicrobia (miscellaneous)
  MG1-253 HNH domain

SEQ ID NO: 3884 - protein, 152 aa, Unknown; identical to SEQ ID NO: 3692
  Description of Unknown: uncultivated organism with predicted taxonomy: unclassified Verrucomicrobia (miscellaneous)
  MG1-254 HNH domain

SEQ ID NO: 3885 - protein, 152 aa, Unknown; identical to SEQ ID NO: 3692
  Description of Unknown: uncultivated organism with predicted taxonomy: unclassified Verrucomicrobia (miscellaneous)
  MG1-255 HNH domain

SEQ ID NO: 3886 - protein, 152 aa, Unknown; identical to SEQ ID NO: 3692
  Description of Unknown: uncultivated organism with predicted taxonomy: unclassified Verrucomicrobia (miscellaneous)
  MG1-256 HNH domain

SEQ ID NO: 3887 - protein, 152 aa, Unknown; identical to SEQ ID NO: 3692
  Description of Unknown: uncultivated organism with predicted taxonomy: unclassified Verrucomicrobia (miscellaneous)
  MG1-257 HNH domain

SEQ ID NO: 3888 - protein, 158 aa, Unknown; identical to SEQ ID NO: 3723
  Description of Unknown: uncultivated organism with predicted taxonomy: Verrucomicrobia
  MG1-258 HNH domain

SEQ ID NO: 3889 - protein, 152 aa, Unknown; identical to SEQ ID NO: 3692
  Description of Unknown: uncultivated organism with predicted taxonomy: unclassified Verrucomicrobia (miscellaneous)
  MG1-259 HNH domain

SEQ ID NO: 3890 - protein, 152 aa, Unknown; identical to SEQ ID NO: 3764
  Description of Unknown: uncultivated organism with predicted taxonomy: unclassified Verrucomicrobia (miscellaneous)
  MG1-260 HNH domain

SEQ ID NO: 3891 - protein, 152 aa, Unknown; identical to SEQ ID NO: 3692
  Description of Unknown: uncultivated organism with predicted taxonomy: unclassified Verrucomicrobia (miscellaneous)
  MG1-261 HNH domain

SEQ ID NO: 3892 - protein, 152 aa, Unknown; identical to SEQ ID NO: 3641
  Description of Unknown: uncultivated organism with predicted taxonomy: unclassified Verrucomicrobia (miscellaneous)
  MG1-262 HNH domain

SEQ ID NO: 3893 - protein, 152 aa, Unknown; identical to SEQ ID NO: 3788
  Description of Unknown: uncultivated organism with predicted taxonomy: Verrucomicrobia
  MG1-263 HNH domain

SEQ ID NO: 3894 - protein, 152 aa, Unknown; identical to SEQ ID NO: 3641
  Description of Unknown: uncultivated organism with predicted taxonomy: unclassified Verrucomicrobia (miscellaneous)
  MG1-264 HNH domain

SEQ ID NO: 3895 - protein, 152 aa, Unknown; identical to SEQ ID NO: 3794
  Description of Unknown: uncultivated organism with predicted taxonomy: unclassified Verrucomicrobia (miscellaneous)
  MG1-265 HNH domain

SEQ ID NO: 3896 - protein, 152 aa, Unknown; identical to SEQ ID NO: 3716
  Description of Unknown: uncultivated organism with predicted taxonomy: Coraliomargarita sp. CAG:312
  MG1-266 HNH domain

SEQ ID NO: 3897 - protein, 158 aa, Unknown; identical to SEQ ID NO: 3740
  Description of Unknown: uncultivated organism with predicted taxonomy: Verrucomicrobia
  MG1-267 HNH domain

SEQ ID NO: 3898 - protein, 152 aa, Unknown; identical to SEQ ID NO: 3692
  Description of Unknown: uncultivated organism with predicted taxonomy: Verrucomicrobia
  MG1-268 HNH domain

SEQ ID NO: 3899 - protein, 152 aa, Unknown; identical to SEQ ID NO: 3692
  Description of Unknown: uncultivated organism with predicted taxonomy: unclassified Verrucomicrobia (miscellaneous)
  MG1-269 HNH domain

SEQ ID NO: 3900 - protein, 152 aa, Unknown; identical to SEQ ID NO: 3733
  Description of Unknown: uncultivated organism with predicted taxonomy: Verrucomicrobia
  MG1-270 HNH domain

SEQ ID NO: 3901 - protein, 152 aa, Unknown; identical to SEQ ID NO: 3692
  Description of Unknown: uncultivated organism with predicted taxonomy: unclassified Verrucomicrobia (miscellaneous)
  MG1-271 HNH domain

SEQ ID NO: 3902 - protein, 183 aa, Unknown
  Description of Unknown: uncultivated organism
  MG1-272 HNH domain
ELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKL

SEQ ID NO: 3903 - protein, 185 aa, Unknown
  Description of Unknown: uncultivated organism with predicted taxonomy: Rhizobiales
  MG1-273 HNH domain
DLMMNQEQKDAKEAKDKERRKERDEAAQILRDMGFAPDADNIKKFLLAQEAGWRCPFTLRPFCQSDFSQLTVTQLIQAENKPRFVKEASSVFDRLEIEHLVPRTPVVCNEWFNLTVTLHSTNAQKRKRTPFQWLFADKDGLPADLDWERIRKNAVERFGESSLKYQVFTSPDGAKLVEDNAKKSI

SEQ ID NO: 3904 - protein, 185 aa, Unknown
  Description of Unknown: uncultivated organism
  MG1-274 HNH domain
DLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSI

SEQ ID NO: 3905 - protein, 161 aa, Unknown; identical to SEQ ID NO: 3650
  Description of Unknown: uncultivated organism
  MG1-275 HNH domain

SEQ ID NO: 3906 - protein, 151 aa, Unknown
  Description of Unknown: uncultivated organism with predicted taxonomy: Verrucomicrobia bacterium IMCC26134
  MG1-276 HNH domain
EDFMGQKAKLEYLKFQRERARARAEAREEAAKAGATENSAGLKMELHKAQGGICLYTGDGLAVTSLDDYDIDHIVPESQGGPDALLNKVLTTRLANREKANRTPYEWLASSDRWDAYVERGKKRLTTLRNKKVQLLTSPEATALVEKYTAL

SEQ ID NO: 3907 - protein, 153 aa, Unknown
  Description of Unknown: uncultivated organism
  MG1-277 HNH domain
SLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDL

SEQ ID NO: 3908 - protein, 108 aa, Unknown
  Description of Unknown: uncultivated organism with predicted taxonomy: Pedosphaera sp. Tous-C6FEB
  MG1-278 HNH domain
EDFMGEEAVKKYQRFLNDRADERKKAREEAEKLGLESRSSGLRYELFKAQGGICLYTGKSLGETSLDDYEIDHIVPRSLGVPDAALNYVLTFHDVNHAKEKGKLTPYA

SEQ ID NO: 3909 - protein, 151 aa, Unknown
  Description of Unknown: uncultivated organism
  MG1-279 HNH domain
SLALGQKAKNELNQRNEKFRKERENAREQLSSNKESFSRKAIQRYRLWQEAKGRCPFCLQMIERTELGHGADIEHLVPRSIVDCNEFYNLTVAHIKCNRELKGDRTPFAAFSGTSQWPDIKDHAEKTFFGRKLEIFLSPDAEQLIEQKSDL

SEQ ID NO: 3910 - protein, 183 aa, Unknown; identical to SEQ ID NO: 3902
  Description of Unknown: uncultivated organism
  MG1-280 HNH domain

SEQ ID NO: 3911 - protein, 153 aa, Unknown; identical to SEQ ID NO: 3907
  Description of Unknown: uncultivated organism with predicted taxonomy: Thermoflexibacter ruber
  MG1-281 HNH domain

SEQ ID NO: 3912 - protein, 153 aa, Unknown; identical to SEQ ID NO: 3907
  Description of Unknown: uncultivated organism
  MG1-282 HNH domain

SEQ ID NO: 3913 - protein, 158 aa, Unknown
  Description of Unknown: uncultivated organism with predicted taxonomy: Verrucomicrobia bacterium IMCC26134
  MG1-283 HNH domain
EDFMGEKAKRELKDFQDKREAARKKAREKATAAGSEEKSAALKFELCEAQGFICLYCGQPFATTKLNECRIEHIVPTAQGGPDAMVNYVAAHDECNEAKGKQTPFQWWHHNTSGKAPTISWDGYKALVDKYATTLRNKKVQLLTREDAVELVGRYTAL

SEQ ID NO: 3914 - protein, 153 aa, Unknown
  Description of Unknown: uncultivated organism
  MG1-284 HNH domain
SLAMGEKKRREHIQRIKENRDERESIRTELKKDNFSSSKNSILRYRLFKEAKGRCPFCLCPFCLQEVVYKEAEIEHIVPRSRVDCNEFYNLTVAHQECNKKKDSRTPWEAYGTTKDWEALRKNAEDCFGLGSLKYRLFTNPDAQNLVEEKSDL

SEQ ID NO: 3915 - protein, 153 aa, Unknown
  Description of Unknown: uncultivated organism with predicted taxonomy: Verrucomicrobia
  MG1-285 HNH domain
EDFMGKKAKIEYFSFIKRRAEERIKAREEAANAGATEKSAGLKLELLRAQDGCCLYTNEGLVPSRLDEYQIDHIVPRSKGGPDAVVNYALTTQKANEAKADRTPYDWFHQEMPDKWDAYVNRVRSRATHLRNKKVQLLVALNAAELADKYTAL

SEQ ID NO: 3916 - protein, 153 aa, Unknown; identical to SEQ ID NO: 3642
  Description of Unknown: uncultivated organism with predicted taxonomy: Verrucomicrobia
  MG1-287 HNH domain

SEQ ID NO: 3917 - protein, 153 aa, Unknown; identical to SEQ ID NO: 3642
  Description of Unknown: uncultivated organism
  MG1-288 HNH domain

SEQ ID NO: 3918 - protein, 47 aa, Unknown
  Description of Unknown: uncultivated organism with predicted taxonomy: Pedosphaera sp. Tous-C6FEB
  MG1-289 HNH domain
EDFMGEEAKREYQNFINEREKDRKAAREEAGKLGFDSRSSGLRYELW

SEQ ID NO: 3919 - protein, 151 aa, Unknown
  Description of Unknown: uncultivated organism with predicted taxonomy: Deltaproteobacteria bacterium RIFOXYA12_FULL_61_11
  MG1-290 HNH domain
SLGLGKKANDDLKKKQATQREEREAARQEAAEHHAAGSQAVLRFRLAKEVGKVCPYCHQPFHADLADAEIEHILPRALGGSDQQVNLTVAHTHCNHEKHDQLPHAAWGEADRWPCLERFAREHFKGLKLQLFLHQGNPEEALALLAPPADL

SEQ ID NO: 3920 - protein, 149 aa, Unknown
  Description of Unknown: uncultivated organism with predicted taxonomy: Candidatus Termititenax aidoneus
  MG1-291 HNH domain
EDFMGDKKRREYIKIMNQRRKAKDEAFNEIKDLVKGKQSLIKQLLLKEQGCKDIYSYETLIPSQLNDYEIDHIVPRSKGGSDAMYNKVLTKASNNQEKGNRIPFEWLSADKEKWNMFYKNVESFRLNWKKKELLLAKDPTLLIEKYTTL

SEQ ID NO: 3921 - protein, 155 aa, Unknown
  Description of Unknown: uncultivated organism with predicted taxonomy: Candidatus Termititenax aidoneus
  MG1-292 HNH domain
DEFMGKQAKEDYYKFIKEQTKERKIVVEELEKAGFSKPSGEMIRKMMLFRQQDGIDFYSMQNIKLSHLGEYEIDHVIPRSRGGSDAFYNIILTTNKNNSAKGDKTPYEWLGKGDIWDNISEKLKVNKKMGSKKKLLFMASSEEQYKLLIDKYTQL

SEQ ID NO: 3922 - protein, 155 aa, Unknown; identical to SEQ ID NO: 3921
  Description of Unknown: uncultivated organism with predicted taxonomy: Elusimicrobia bacterium HGW-Elusimicrobia-1
  MG1-293 HNH domain

SEQ ID NO: 3923 - protein, 157 aa, Unknown
  Description of Unknown: uncultivated organism with predicted taxonomy: Endomicrobium proavitum
  MG1-294 HNH domain
EDFAGEEKRKEYIDTQNKNTKNIELAVKLLKEANKQLNNRNILKARLLIEQNNVDLYEIDEHRKISITNIDDYEIDHIIPRSRGGSDSFSNFVITSINNNQTKLNRTPYEWFHQDKSFDAWNTYIKNIEGIKGLSKHKIKLLISDKAIELENKKTDL

SEQ ID NO: 3924 - protein, 149 aa, Unknown
  Description of Unknown: uncultivated organism with predicted taxonomy: Verrucomicrobia bacterium 12-59-8
  MG1-295 HNH domain
EDFMGEEAKKKLQKFQNENRKAWDQARSQARELNLSGGGNVRKLRMLREQNFICPYTGDTLSENEVDTLEVEHIVPRARGGSDNQYNKVVTRTRTNREKGDHTPYEWLTQKEEFAAFCERVEKMGLSRKKKEILTAKDPFTLDQKWDSL

SEQ ID NO: 3925 - protein, 166 aa, Unknown
  Description of Unknown: uncultivated organism
  MG1-296 HNH domain
EEFLGEDKRAQYIKTQNENRKDKDLAKEELMTVIKSADPSYQTKLLKVRLLREQHYKDVYDLTENCALSIQDIDDYDIDHIVPISCGGADSMVNKVLTKKELNETKKQNQTPYEMYFQNASAETWAKYLEHLKDVYGKNISKHLEKKYELLTSDKAIEIESKRNDL

SEQ ID NO: 3926 - protein, 149 aa, Unknown
  Description of Unknown: uncultivated organism with predicted taxonomy: Verrucomicrobia bacterium 12-59-8
  MG1-297 HNH domain
EDFMGEEAKEKPKKFQNENRKAWDQARSQARELNLSGGGNVRKLRMLREQNFICPYTGDTLSENEVDTLEVEHIVPRARGGSDNQYNKVVTRSQTNREKGDHTPYEWLTQKGEFAAFCERVEKMGLSRKKKEILTAKDPFTLDQKWDSL

SEQ ID NO: 3927 - protein, 158 aa, Unknown
  Description of Unknown: uncultivated organism
  MG1-298 HNH domain
DEFLSEEEKADLNRANKERQKNNKKAYEELKKYGLEISHDNMEKYKLCESQKWTDIYNVFDDKKKISPEDLPNYDIDHIVPVSSGGADSLANKVVTARHLNQSQKSNKTPYQWLFEDKIKWADFLENIKNAGIDKNSKKYLFLTAKDAVSQAKSLNDL

SEQ ID NO: 3928 - protein, 154 aa, Unknown
  Description of Unknown: uncultivated organism
  MG1-299 HNH domain
EDFMGDKARMELKKFQNDRAKARAEARERVAELGISEKNSLRYELWKAQGGRCLYTDDPLAETELDNYHVDHIVPRAKGGPDSRLNYVLTLNQTNDDKDDRTPFEWLSCNPARWLAYVNRVESRLKAADGISRKTAQLLTLPNAVELAEKYTAL

SEQ ID NO: 3929 - protein, 154 aa, Unknown
  Description of Unknown: uncultivated organism
  MG1-300 HNH domain
EDFMGEEAKKRYLKFMNDRAKSRAEAREKVAALGISDKNILRYELWKSQGCRCLYTDLPLEETKLDDYKVDHIVPRAQGGPDSRLNYALTHNATNDEKDDRTPYEWLSGDSVKWQAYLNRVNARLKAADGISRKTAQLLTLPNAAELAEKYTAL

SEQ ID NO: 3930 - protein, 154 aa, Unknown
  Description of Unknown: uncultivated organism
  MG1-301 HNH domain
EDFMGEKARMELRNFQNRRAKARAEARERVAELGISEKNSLRYELFKAQGGRCLYTDDPLAETELDNYRVDHIVPRAKGGPDSRLNYALTLNQTNDDKGDRTPYEWLSGNPVRWQAYLNRVEARLKTTDGISRKTAQLLTLPNAVELAEKYTAL

SEQ ID NO: 3931 - protein, 154 aa, Unknown
  Description of Unknown: uncultivated organism
  MG1-302 HNH domain
EDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTAL

SEQ ID NO: 3932 - protein, 154 aa, Unknown; identical to SEQ ID NO: 3931
  Description of Unknown: uncultivated organism
  MG1-303 HNH domain

SEQ ID NO: 3933 - protein, 160 aa, Unknown
  Description of Unknown: uncultivated organism with predicted taxonomy: Verrucomicrobia
  MG1-304 HNH domain
NDKDNSLEGQKRTQVYQDILKRNEDRRETARKALRASSLPDSDEMVVRWLLYQEQGPFCIYSGQPIRCSELPNLQIEHIVPRALGGPDAYWNWVLCKTDQNVEKGNRVPYQWFHEEKKSGEWEDYRRRVRNRATWLGSRKVDLLLRADAKELVGEKYTAL

SEQ ID NO: 3934 - protein, 154 aa, Unknown
  Description of Unknown: uncultivated organism with predicted taxonomy: Verrucomicrobia bacterium IMCC26134
  MG1-305 HNH domain
EDFMGDKARMELKKFQNDRAKARAEARERVAELGISEKNSLRYELWKAQGGRCLYMDDPLAETELDNYRIDHIVPRAKCGPDSRLNYALTLNQTNDDKGDRTPYEWLSGNPERWRAYLNRVEARLRAADGISRKTAQLLTLPNAVELAEKFTAL

SEQ ID NO: 3935 - protein, 151 aa, Unknown
  Description of Unknown: uncultivated organism with predicted taxonomy: Verrucomicrobia
  MG1-306 HNH domain
EDFMGKKAKIEYFKFQRDRAAQRAKAREEAAKAGAGEGAAGLKMELLEAQGGACLYTGEALAPTSLDDYVIDHIVPRAKGGPDSALNYVLTTRRANDDKADRTPHEWLSATNGWDAYVERVKKRTTALRNKKASLLVSPEAETLVQRYTAL

SEQ ID NO: 3936 - protein, 185 aa, Unknown; identical to SEQ ID NO: 3904
  Description of Unknown: uncultivated organism with predicted taxonomy: Verrucomicrobia bacterium IMCC26134
  MG1-307 HNH domain

SEQ ID NO: 3937 - protein, 172 aa, Unknown
  Description of Unknown: uncultivated organism
  MG1-308 HNH domain
DPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTA

SEQ ID NO: 3938 - protein, 154 aa, Unknown
  Description of Unknown: uncultivated organism
  MG1-309 HNH domain
DMPRNQDQSREIQKEQKERREERRHIAAIYGLDFDVLTEPQKRRLFLFHEQAGRDGEAVCPYTGESLGRDPLAADLEIEHIYPQRRGGLSIMENLAITRRATNAEKGNRTPVEWLGYEKAAEQASRMRWSKRKLEVFLWREERCPDWENLTRTA

SEQ ID NO: 3939 - protein, 167 aa, Unknown
  Description of Unknown: uncultivated organism
  MG1-310 HNH domain
DPPRNAQQRAERQKEIEANREKHEKLFEQYGIEDSGVASKRRRIMLYEQQRGKCPYTGKDLPSNPLDPSLEIEHIFPAEMGGLSVDDNLVLTWRSVNAEKGKRTPLQWAGERFDAMLANTRDMRWSARKREIFAWGTIREDKPDKPSHYNADGTLRVPDFGNTTRTA

SEQ ID NO: 3940 - protein, 171 aa, Unknown
  Description of Unknown: uncultivated organism
  MG1-311 HNH domain
DAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTA

SEQ ID NO: 3941 - protein, 171 aa, Unknown; identical to SEQ ID NO: 3940
  Description of Unknown: uncultivated organism
  MG1-312 HNH domain

SEQ ID NO: 3942 - protein, 172 aa, Unknown; identical to SEQ ID NO: 3937
  Description of Unknown: uncultivated organism
  MG1-314 HNH domain

SEQ ID NO: 3943 - protein, 171 aa, Unknown
  Description of Unknown: uncultivated organism with predicted taxonomy: Verrucomicrobia bacterium
  MG1-315 HNH domain
DAPRTTKQAQEIKFAQDERGQKRRELFAARNLEDSGVASKRRRISLWDQQKGVCPYTGNELPKDPLDPSLELEHIFPAEMGGLSTDENLVLTSRTVNSDKGKHTPLQFANKLRVPFDQLVAHTQDMRWSAKKREIFAWGTLREDKDDQKSHYLPDGVSLRVPDFGNTTRTA

SEQ ID NO: 3944 - protein, 185 aa, Unknown; identical to SEQ ID NO: 3904
  Description of Unknown: uncultivated organism with predicted taxonomy: Thiorhodospira sibirica
  MG1-316 HNH domain

SEQ ID NO: 3945 - protein, 170 aa, Unknown
  Description of Unknown: uncultivated organism
  MG1-317 HNH domain
DPPRNALQRAERDQEMKERREKRNKLFEQHHLDDSGVASRRRRVTLWEQQKGKCPFTGKELPANPLDPSLELEHIFPEDMGGLSVEENLALTWRTVNADKGKRTPLQFAAKLGVPFDQLMAHTQEMRWSAKKREIFAWGAIKEDRGDQASHYNPDGALRIPDFGNITRMA

SEQ ID NO: 3946 - protein, 171 aa, Unknown; identical to SEQ ID NO: 3940
  Description of Unknown: uncultivated organism
  MG1-318 HNH domain

SEQ ID NO: 3947 - protein, 153 aa, Unknown
  Description of Unknown: uncultivated organism with predicted taxonomy: Verrucomicrobia bacterium IMCC26134
  AKC83434.1 HNH domain
TDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTAL

SEQ ID NO: 3948 - protein, 153 aa, Unknown; identical to SEQ ID NO: 3947
  Description of Unknown: uncultivated organism with predicted taxonomy: Verrucomicrobia bacterium IMCC26134
  AKC83434.1 HNH domain

SEQ ID NO: 3949 - protein, 151 aa, Unknown
  Description of Unknown: uncultivated organism with predicted taxonomy: Verrucomicrobia bacterium 61-8
  OJV06180.1 HNH domain
EDFMGKKAVIEYRAFLKKREAERKRAREDAAKTGSTERSAALKLELLREQGGICLYTGSALKETALEQYEIDHIVPRSKGGPDAVINYVLTLRSANDEKGDRTPFEWLSRTNQWDAYVQRVDSRGTVLRNKKTKLLLNENASELAERYTAL

SEQ ID NO: 3950 - protein, 151 aa, Unknown; identical to SEQ ID NO: 3949
  Description of Unknown: uncultivated organism with predicted taxonomy: Verrucomicrobia bacterium 61-8
  OJV06180.1 HNH domain

SEQ ID NO: 3951 - protein, 168 aa, Unknown
  Description of Unknown: uncultivated organism with predicted taxonomy: Pedosphaera sp. Tous-C6FEB
  PAW75411.1 HNH domain
EDFMGEKALAELQDFQRRREADRKEAKEMAAAAGATSSLSALKYQLWKAQGGECLYGKEVFNESGVSKAQCLYRGTALPFTKLDDYVIDHIVPRAKGGPDAMVNYVLTTHETNEAKGDRTPFEWLRSAPDWDAYNKRVAARAHTLRNKKVQLLTREDAPELVQRYTAL

SEQ ID NO: 3952 - protein, 168 aa, Unknown; identical to SEQ ID NO: 3951
  Description of Unknown: uncultivated organism with predicted taxonomy: Pedosphaera sp. Tous-C6FEB
  PAW75411.1 HNH domain

SEQ ID NO: 3953 - protein, 153 aa, Unknown; identical to SEQ ID NO: 3947
  Description of Unknown: uncultivated organism with predicted taxonomy: Verrucomicrobia bacterium IMCC26134
  WP_082083265.1 HNH domain

SEQ ID NO: 3954 - protein, 153 aa, Unknown; identical to SEQ ID NO: 3947
  Description of Unknown: uncultivated organism with predicted taxonomy: Verrucomicrobia bacterium IMCC26134
  WP_082083265.1 HNH domain

SEQ ID NO: 3955 - protein, 157 aa, Unknown; identical to SEQ ID NO: 3711
  Description of Unknown: uncultivated organism
  MG2-1 HNH domain

SEQ ID NO: 3956 - protein, 185 aa, Unknown
  Description of Unknown: uncultivated organism
  MG2-7 HNH domain
ELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDL

SEQ ID NO: 3957 - protein, 210 aa, Unknown
  Description of Unknown: uncultivated organism
  MG2-3 HNH domain
DILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDL

SEQ ID NO: 3958 - protein, 195 aa, Unknown
  Description of Unknown: uncultivated organism with predicted taxonomy: Verrucomicrobia
  MG2-5 HNH domain
DLREMSGKSNYDKQADLNNRVKNHHSVVEYLHEHLPAKYHNRINGSLIRKARVAADLDWKCPYTNEAIQPIHLITKVVDLDHVVPHALRPSDGLDSLVVTFCAVNKMKGKRTAWQFIKDEETRSVSYRNEQGKEEKVDGMPNLKIRFFSDYKKFVDDLKIKAKGEHKADAERRERRQQLLRLANYEEKAFLPRDL

SEQ ID NO: 3959 - protein, 179 aa, Unknown
  Description of Unknown: uncultivated organism with predicted taxonomy: Verrucomicrobia bacterium
  MG2-6 HNH domain
DLREFSGMTAKEIASELTKITSDHRKAVQYLEENLKGKPYKITASLIRKTRIAMDLDWTCPYTGQKYDIYDLLEKRVDLDHIIPQSIRPSNSLESLVITFPEVNRFKAQRLAFQFVKEEQTKTVKGLPNLQIRTLENYKNWGENLKESRFDRNKSPQSKRKKLLLLPEYVQEEFLPRDL

SEQ ID NO: 3960 - protein, 187 aa, Unknown
  Description of Unknown: uncultivated organism with predicted taxonomy: Verrucomicrobia
  MG2-8 HNH domain
DLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDL

SEQ ID NO: 3961 - protein, 187 aa, Unknown; identical to SEQ ID NO: 3960
  Description of Unknown: uncultivated organism with predicted taxonomy: Verrucomicrobia
  MG2-10 HNH domain

SEQ ID NO: 3962 - protein, 193 aa, Unknown
  Description of Unknown: uncultivated organism
  MG2-11 HNH domain
DLREISGKTAKEKAQELGQRLANFKSVTKKLEEAFEGRNVHISPGLIRKARVAEDLGWTCPYTGQRYDPLDLLNAKVDKDHVIPRTERASDSLDSLVITFPAVNKWKDKRTALKFIEDEQGQPVLDMPNLSIKTFAQYEADVKALRPSFDPRPAKRDGRTKGPIDDDLRRWNRKQLLLNVRKWEEKEFLPRDL

SEQ ID NO: 3963 - protein, 187 aa, Unknown
  Description of Unknown: uncultivated organism with predicted taxonomy: Verrucomicrobia bacterium
  MG2-12 HNH domain
DVQTTSGMTNKEKAKELGSKIKHHHETAAWLAERLEDERDENGRRFVIGPSLIRKARIADDLGWECPYTGRKFEPADLIHRRYDKDHIVPRSKRLSDALEAMVITSCEVNREKKNRTALQFIKDMNLPENRAVRERLNIRTEAQFREFVDELKAKGSHADDVRRRKRRKELLLVQKYEEKEFTPADL

SEQ ID NO: 3964 - protein, 180 aa, Unknown
  Description of Unknown: uncultivated organism with predicted taxonomy: Verrucomicrobia bacterium
  MG2-13 HNH domain
DLREMSGKTAKEKAQDLGQRLANFKNVAEKLEEAFEGKDVHISPGLIRKARIAEDLGWTCPYTHHSYDAFQLLNRTVDKDHIIPRTERASDSLDSLVITFSAINKWKGKRTAMKFVEDEQGNPVPDMPNLSIVTLTHYKAFVEGLDTFRGHDDDKRRKKNRQRLLLVRDYEKPEFTPRDL

SEQ ID NO: 3965 - protein, 190 aa, Unknown
  Description of Unknown: uncultivated organism with predicted taxonomy: Verrucomicrobia bacterium
  MG2-14 HNH domain
DLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDTRGESHTFSPKEFREFVGGLKNKNGPAKDDEVRCKKRKIALLTPIYERRGKVKQTDTGEEVLEAFTDGTL

SEQ ID NO: 3966 - protein, 190 aa, Unknown
  Description of Unknown: uncultivated organism with predicted taxonomy: Verrucomicrobia bacterium
  MG2-15 HNH domain
DLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDPRGESHTFSPKEFREFVGRLKNKNGPAKDDEVRCKKRKIALLTPIYERRGKVKQTDTGEEVLEAFTDGTL

SEQ ID NO: 3967 - protein, 197 aa, Unknown
  Description of Unknown: uncultivated organism with predicted taxonomy: Verrucomicrobia bacterium
  MG2-16 HNH domain
DLREMSGKTAKEKAQYFRLLTADHHRVAEKLKKALAGQTVDGKPIRISASRIRKARVAEDLNWTCPYTGQKYEPIDLVTERVDEDHIVPRSQRMSDSLESLVISFSAVNKWKGKRTAMRFIKEEQGKPVPGLPNLSIVSLNRYLEFVDSLPPRNDPRKLKRHLKLLQPIDDDLRKWRRKELLKLEEYEQEEFTPRDL

SEQ ID NO: 3968 - protein, 210 aa, Unknown; identical to SEQ ID NO: 3957
  Description of Unknown: uncultivated organism
  MG2-17 HNH domain

SEQ ID NO: 3969 - protein, 185 aa, Unknown
  Description of Unknown: uncultivated organism with predicted taxonomy: Verrucomicrobia
  MG2-18 HNH domain
DLREFSGKTAKEKAQDLGLRIADHHRVAEKLQKALAGQTLNGQPIRIGPALIRKARIAEDLGWTCPYTGQKYEPIDLVTRRVDKDHIVPRSQRASDSLDSMVITFSAINKWKGKRTALKFVEDEQGKPVPDLPNLSIVSLSRYRDFVEKLDTFKGHDQDKKRKKRRKALLLVRDYEEEEFTPRDL

SEQ ID NO: 3970 - protein, 182 aa, Unknown
  Description of Unknown: uncultivated organism with predicted taxonomy: Verrucomicrobia
  MG2-19 HNH domain
DLREFSGMTAKEIESELNARSADFKKAKKQLEDMLLKAGLSNTRITATLIKKARIAQDLDFTCPYTGAKYELIDLINKQVDLEHIIPKSKRPSDSMESLVITFKEVNRWKGNRTALRFIKEEQNKPVQGKGNLMILTEKRYQELVNGLNTKGHPKDTERKKKRKELLLMEDYVEEEFLPRDL

SEQ ID NO: 3971 - protein, 180 aa, Unknown
  Description of Unknown: uncultivated organism with predicted taxonomy: Verrucomicrobia bacterium
  MG2-20 HNH domain
ELRDLSGKTRKEQEQDLGLRLGDFKRVAAKVEEACRRRGIPCTAGLIRKARVAEDLGWKCPYTGKEFSVDTLLDGVMDKDHIIPHADRQSDSLDSLVITWNEVNKWKGKRTALEFIREEGGKPVPGRPELTVMTLAEFQKHVASLDIRKGHDDDRARKKRRIRRLLTEYYEEKEFTPRDL

SEQ ID NO: 3972 - protein, 182 aa, Unknown
  Description of Unknown: uncultivated organism
  MG2-21 HNH domain
DLREFSGMTAKEIESELNARSADFKKAKKQLENMLQEAGLSNTRITATLIKKARIAQDLDFTCPYTGAKYELIDLINKQVDLEHIIPKSKRPSDSMESLVITFKEVNRWKGNRTALRFIKEEQNKPVPGKENLMILTEKRYQELVNGLNTKGHPKDTERKKKRKELLLMEDYVEEKFLPRDL

SEQ ID NO: 3973 - protein, 210 aa, Unknown; identical to SEQ ID NO: 3957
  Description of Unknown: uncultivated organism
  MG2-22 HNH domain

SEQ ID NO: 3974 - protein, 185 aa, Unknown
  Description of Unknown: uncultivated organism with predicted taxonomy: Verrucomicrobia bacterium
  MG2-23 HNH domain
DLREFSGKTAKEKTQDLGLRVADHHRVAEKLQKALAGQTVNGQPIRIGPGLIRKARIAEDLGWTCPYTGQKYEPIDLVTRRVDKDHIVPRSQRMSDSLDSLVITFSAINKWKGNRTALKFVEDEQGKPVPDLPNLSIVSLSRYREFVEKLETFKGHDDDKKRKKRRKALLLLRDYEEEEFTPRDL

SEQ ID NO: 3975 - protein, 180 aa, Unknown
  Description of Unknown: uncultivated organism with predicted taxonomy: Verrucomicrobia bacterium
  MG2-24 HNH domain
DLRDLSGKTRKEQEQDLGLRLGDFKRVAAKVEEACKRRNLRVTAGIIRKARVAEDLGWRCPYTGKEFCIDTLLDGVMDKEHIIPHADRQSDSLDSLVITWNEVNKWKGKRTAMEFIREEGGKPVPGRPELEIMSLAAFQKHVASLDTRKGHDDDRARKKRRIRRLLTEHYEEKEFTPRDL

SEQ ID NO: 3976 - protein, 185 aa, Unknown
  Description of Unknown: uncultivated organism
  MG2-25 HNH domain
DLREFSGMTRKAIEMDLGSRLKNFKSVSDKLEKAFDSQTYNGKPVQVTAGLIRKARIAEDLGWQCPYTGQSFEPVHLVSRAVDKDHVIPRSQRPSDSLESLVVTFSEVNKMKGQRTAWQFIQEFGGKPVEGMPNLMIRTPKQFEEFVTKLESFKGHEDDKRRKKRRKDLLLLPKFEDKGFVPRDL

SEQ ID NO: 3977 - protein, 180 aa, Unknown
  Description of Unknown: uncultivated organism with predicted taxonomy: Verrucomicrobia bacterium
  MG2-26 HNH domain
DLRELSGKTRKEQEQDLGQRLANFKSVVRKLEESFDGKKVKITPGLIRKARVAEDLGWTCPYTGKAYDAFDLLNRAVDKDHIIPRSQRASDSLDSLVITFAEVNKMKGKRTALRFIEEFQGQPVPGAPRLSLRTLRDYQQWVEGLETFKGHPDDQRRKKQRKKLLLLPEYVEKDFVPRDL

SEQ ID NO: 3978 - protein, 181 aa, Unknown
  Description of Unknown: uncultivated organism
  MG2-27 HNH domain
DLRSFSGMTAEEKKQEMGQRLGDFKKVVQKLRGDLPEVTAISAGLIRKARIAQDMNWTCPYTGMEYDALDLLHGHVDKDHIIPRSLRPSDSLDSLVLTLRTINEMKGQRTAVQFIKEFEGREVQDGKKRSLEILPWSQFQKLVESLDAKGIHDQDRARKKRRKALLLQEHYTEKEFVPKDL

SEQ ID NO: 3979 - protein, 180 aa, Unknown
  Description of Unknown: uncultivated organism with predicted taxonomy: Verrucomicrobia
  MG2-28 HNH domain
DLREMAGRTSQEIAKELGARVANHKKVANRLFGELPEGTRITGSLIRKARIADDLGWRCPYTGVEFEPVDLVEGRVDRDHIIPRSQRMSDSLDSLVITFSAVNKWKGQRTAWQFIQEEGGKPVPDAPNLSIVTPARFRDFVEHLDTKGHRDDYRRKKRRKELLLLERYEERTSGFTPGQL

SEQ ID NO: 3980 - protein, 182 aa, Unknown
  Description of Unknown: uncultivated organism with predicted taxonomy: Verrucomicrobia bacterium
  MG2-29 HNH domain
EVSSMSGKTMKLIKMEEGLKRSDHKKASKIMEAAVEESGENIRVGAGLIRKARVAQDLDWTCPYTGEKFDPLALIHSQVDLDHIIPRSERLSDAMAGLVVTFSEINRWKGARTAYQFISEEQGKQVPGKPNLSIMSLKAYEDFVGKLKISGGHDSDVGRRKARKGYLLLASYQDKEFTPRDL

SEQ ID NO: 3981 - protein, 182 aa, Unknown
  Description of Unknown: uncultivated organism with predicted taxonomy: Verrucomicrobia bacterium
  MG2-30 HNH domain
EISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDL

SEQ ID NO: 3982 - protein, 182 aa, Unknown; identical to SEQ ID NO: 3981
  Description of Unknown: uncultivated organism with predicted taxonomy: Verrucomicrobia bacterium
  MG2-31 HNH domain

SEQ ID NO: 3983 - protein, 182 aa, Unknown; identical to SEQ ID NO: 3981
  Description of Unknown: uncultivated organism with predicted taxonomy: Verrucomicrobia bacterium
  MG2-32 HNH domain

SEQ ID NO: 3984 - protein, 182 aa, Unknown; identical to SEQ ID NO: 3981
  Description of Unknown: uncultivated organism with predicted taxonomy: Verrucomicrobia bacterium
  MG2-33 HNH domain

SEQ ID NO: 3985 - protein, 182 aa, Unknown; identical to SEQ ID NO: 3981
  Description of Unknown: uncultivated organism with predicted taxonomy: Verrucomicrobia bacterium
  MG2-34 HNH domain

SEQ ID NO: 3986 - protein, 188 aa, Unknown
  Description of Unknown: uncultivated organism with predicted taxonomy: Thermogutta terrifontis
  MG2-35 HNH domain
DLVEFSGKSAKEKARILGQQLWHHRKISKFLEEEKAKNEGNWEISAGLIKKARIADDLNWICPYTGKQYSLNQIIHGDVDLEHIIPRSKRPTDALHALVLTFSHINREKGARTGLQYIEDTKDSPHTLTPEQYRKFVGRLKKNGPSKDDELRCTKRKIALLTQDYEPRGKAKEKSDSESVSGFTEGSL

SEQ ID NO: 3987 - protein, 183 aa, Unknown
  Description of Unknown: uncultivated organism with predicted taxonomy: Coraliomargarita sp. CAG:312
  MG2-36 HNH domain
DITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDL

SEQ ID NO: 3988 - protein, 183 aa, Unknown
  Description of Unknown: uncultivated organism with predicted taxonomy: Coraliomargarita sp. CAG:312
  MG2-37 HNH domain
DMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADL

SEQ ID NO: 3989 - protein, 183 aa, Unknown; identical to SEQ ID NO: 3987
  Description of Unknown: uncultivated organism with predicted taxonomy: Coraliomargarita sp. CAG:312
  MG2-38 HNH domain

SEQ ID NO: 3990 - protein, 183 aa, Unknown; identical to SEQ ID NO: 3988
  Description of Unknown: uncultivated organism with predicted taxonomy: Verrucomicrobia bacterium
  MG2-39 HNH domain

SEQ ID NO: 3991 - protein, 183 aa, Unknown; identical to SEQ ID NO: 3987
  Description of Unknown: uncultivated organism with predicted taxonomy: Coraliomargarita sp. CAG:312
  MG2-40 HNH domain

SEQ ID NO: 3992 - protein, 183 aa, Unknown; identical to SEQ ID NO: 3988
  Description of Unknown: uncultivated organism with predicted taxonomy: Coraliomargarita sp. CAG:312
  MG2-41 HNH domain

SEQ ID NO: 3993 - protein, 183 aa, Unknown; identical to SEQ ID NO: 3988
  Description of Unknown: uncultivated organism with predicted taxonomy: Coraliomargarita sp. CAG:312
  MG2-42 HNH domain

SEQ ID NO: 3994 - protein, 183 aa, Unknown; identical to SEQ ID NO: 3988
  Description of Unknown: uncultivated organism with predicted taxonomy: Verrucomicrobia
  MG2-43 HNH domain

SEQ ID NO: 3995 - protein, 183 aa, Unknown; identical to SEQ ID NO: 3987
  Description of Unknown: uncultivated organism with predicted taxonomy: Coraliomargarita sp. CAG:312
  MG2-44 HNH domain

SEQ ID NO: 3996 - protein, 183 aa, Unknown; identical to SEQ ID NO: 3988
  Description of Unknown: uncultivated organism with predicted taxonomy: Coraliomargarita sp. CAG:312
  MG2-45 HNH domain

SEQ ID NO: 3997 - protein, 183 aa, Unknown; identical to SEQ ID NO: 3987
  Description of Unknown: uncultivated organism with predicted taxonomy: Coraliomargarita sp. CAG:312
  MG2-46 HNH domain

SEQ ID NO: 3998 - protein, 183 aa, Unknown; identical to SEQ ID NO: 3988
  Description of Unknown: uncultivated organism with predicted taxonomy: Verrucomicrobia bacterium
  MG2-47 HNH domain

SEQ ID NO: 3999 - protein, 183 aa, Unknown
  Description of Unknown: uncultivated organism with predicted taxonomy: Coraliomargarita sp. CAG:312
  MG2-48 HNH domain
DITAFSGLDSKKKAAKLNDLVAHHKSVSAYLKKEYPEISPNGSILRKARIADDLGWVCPYTGCHFSPRQLFESGNMEREHIIPRSLRPSDSLESLVITWKEVNDMKGQCTAYEFIKECQGMKVPGRQNLSIVTPERFEAFVRRLKKPMHPAGKADIERIKIRNKLLLTEHYKKREGGFLPSDL

SEQ ID NO: 4000 - protein, 183 aa, Unknown; identical to SEQ ID NO: 3988
  Description of Unknown: uncultivated organism with predicted taxonomy: Coraliomargarita sp. CAG:312
  MG2-49 HNH domain

SEQ ID NO: 4001 - protein, 183 aa, Unknown; identical to SEQ ID NO: 3987
  Description of Unknown: uncultivated organism with predicted taxonomy: Coraliomargarita sp. CAG:312
  MG2-50 HNH domain

SEQ ID NO: 4002 - protein, 183 aa, Unknown; identical to SEQ ID NO: 3987
  Description of Unknown: uncultivated organism with predicted taxonomy: Coraliomargarita sp. CAG:312
  MG2-51 HNH domain

SEQ ID NO: 4003 - protein, 183 aa, Unknown; identical to SEQ ID NO: 3988
  Description of Unknown: uncultivated organism with predicted taxonomy: Verrucomicrobia bacterium
  MG2-52 HNH domain

SEQ ID NO: 4004 - protein, 183 aa, Unknown; identical to SEQ ID NO: 3988
  Description of Unknown: uncultivated organism with predicted taxonomy: Verrucomicrobia bacterium
  MG2-53 HNH domain

SEQ ID NO: 4005 - protein, 183 aa, Unknown
  Description of Unknown: uncultivated organism with predicted taxonomy: Coraliomargarita sp. CAG:312
  MG2-54 HNH domain
DMTAFSGLDSKKKAAKLKDLVAHHESVSKYLKNEYPNLKTNGSILRKARIADDLGWVCPYTGCHFSPRQLFESGNMEKEHIIPRSLRPSDSLESLVVTWKEVNDMKGQRTALEFIKECQGMKVPGRPNLSIVTPARFEEFVSGLRKPMHRAGKADIERIKIRNKLLLTEHYKNREGEFLPSDL

SEQ ID NO: 4006 - protein, 183 aa, Unknown; identical to SEQ ID NO: 3987
  Description of Unknown: uncultivated organism with predicted taxonomy: Coraliomargarita sp. CAG:312
  MG2-55 HNH domain

SEQ ID NO: 4007 - protein, 183 aa, Unknown; identical to SEQ ID NO: 3987
  Description of Unknown: uncultivated organism with predicted taxonomy: Coraliomargarita sp. CAG:312
  MG2-56 HNH domain

SEQ ID NO: 4008 - protein, 183 aa, Unknown; identical to SEQ ID NO: 3988
  Description of Unknown: uncultivated organism with predicted taxonomy: Coraliomargarita sp. CAG:312
  MG2-57 HNH domain

SEQ ID NO: 4009 - protein, 183 aa, Unknown; identical to SEQ ID NO: 3988
  Description of Unknown: uncultivated organism with predicted taxonomy: Verrucomicrobia bacterium
  MG2-58 HNH domain

SEQ ID NO: 4010 - protein, 183 aa, Unknown; identical to SEQ ID NO: 3987
  Description of Unknown: uncultivated organism with predicted taxonomy: Coraliomargarita sp. CAG:312
  MG2-59 HNH domain

SEQ ID NO: 4011 - protein, 183 aa, Unknown; identical to SEQ ID NO: 3987
  Description of Unknown: uncultivated organism with predicted taxonomy: Coraliomargarita sp. CAG:312
  MG2-60 HNH domain

SEQ ID NO: 4012 - protein, 183 aa, Unknown; identical to SEQ ID NO: 3987
  Description of Unknown: uncultivated organism with predicted taxonomy: Coraliomargarita sp. CAG:312
  MG2-61 HNH domain

SEQ ID NO: 4013 - protein, 185 aa, Unknown
  Description of Unknown: uncultivated organism with predicted taxonomy: Verrucomicrobia
  MG2-62 HNH domain
ELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDL

SEQ ID NO: 4014 - protein, 183 aa, Unknown; identical to SEQ ID NO: 3987
  Description of Unknown: uncultivated organism with predicted taxonomy: Coraliomargarita sp. CAG:312
  MG2-63 HNH domain

SEQ ID NO: 4015 - protein, 183 aa, Unknown; identical to SEQ ID NO: 3987
  Description of Unknown: uncultivated organism with predicted taxonomy: Coraliomargarita sp. CAG:312
  MG2-64 HNH domain

SEQ ID NO: 4016 - protein, 183 aa, Unknown; identical to SEQ ID NO: 3988
  Description of Unknown: uncultivated organism with predicted taxonomy: Coraliomargarita sp. CAG:312
  MG2-65 HNH domain

SEQ ID NO: 4017 - protein, 183 aa, Unknown; identical to SEQ ID NO: 3987
  Description of Unknown: uncultivated organism with predicted taxonomy: Coraliomargarita sp. CAG:312
  MG2-66 HNH domain

SEQ ID NO: 4018 - protein, 183 aa, Unknown; identical to SEQ ID NO: 3987
  Description of Unknown: uncultivated organism with predicted taxonomy: Coraliomargarita sp. CAG:312
  MG2-67 HNH domain

SEQ ID NO: 4019 - protein, 183 aa, Unknown; identical to SEQ ID NO: 3999
  Description of Unknown: uncultivated organism with predicted taxonomy: Coraliomargarita sp. CAG:312
  MG2-68 HNH domain

SEQ ID NO: 4020 - protein, 183 aa, Unknown; identical to SEQ ID NO: 3987
  Description of Unknown: uncultivated organism with predicted taxonomy: Coraliomargarita sp. CAG:312
  MG2-69 HNH domain

SEQ ID NO: 4021 - protein, 183 aa, Unknown; identical to SEQ ID NO: 3987
  Description of Unknown: uncultivated organism with predicted taxonomy: Coraliomargarita sp. CAG:312
  MG2-70 HNH domain

SEQ ID NO: 4022 - protein, 183 aa, Unknown; identical to SEQ ID NO: 3987
  Description of Unknown: uncultivated organism with predicted taxonomy: Coraliomargarita sp. CAG:312
  MG2-71 HNH domain

SEQ ID NO: 4023 - protein, 183 aa, Unknown; identical to SEQ ID NO: 3987
  Description of Unknown: uncultivated organism with predicted taxonomy: Coraliomargarita sp. CAG:312
  MG2-72 HNH domain

SEQ ID NO: 4024 - protein, 183 aa, Unknown; identical to SEQ ID NO: 3988
  Description of Unknown: uncultivated organism with predicted taxonomy: Verrucomicrobia bacterium
  MG2-73 HNH domain

SEQ ID NO: 4025 - protein, 185 aa, Unknown; identical to SEQ ID NO: 4013
  Description of Unknown: uncultivated organism with predicted taxonomy: Verrucomicrobia
  MG2-74 HNH domain

SEQ ID NO: 4026 - protein, 183 aa, Unknown; identical to SEQ ID NO: 3987
  Description of Unknown: uncultivated organism with predicted taxonomy: Coraliomargarita sp. CAG:312
  MG2-75 HNH domain

SEQ ID NO: 4027 - protein, 193 aa, Unknown
  Description of Unknown: uncultivated organism with predicted taxonomy: Verrucomicrobia bacterium
  MG2-76 HNH domain
DLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADL

SEQ ID NO: 4028 - protein, 193 aa, Unknown; identical to SEQ ID NO: 4027
  Description of Unknown: uncultivated organism
  MG2-77 HNH domain

SEQ ID NO: 4029 - protein, 193 aa, Unknown; identical to SEQ ID NO: 4027
  Description of Unknown: uncultivated organism with predicted taxonomy: Verrucomicrobia bacterium
  MG2-78 HNH domain

SEQ ID NO: 4030 - protein, 184 aa, Unknown
  Description of Unknown: uncultivated organism with predicted taxonomy: Verrucomicrobia bacterium
  MG2-79 HNH domain
DLREMSGKTAKEKAQDLGLRIANHHAVAEKLEKAFAEERNGKSIPITAGLIRKARIAEDLGWRCPYTGIDYEPKDLVTKRVDKDHIVPRSERASDSLDSLVITLSAINKWKGKRTAWQFVEQEQGKPVPDLPNLSIVSLTRYKQFVESLETYKGHDDDKRRKKKRKELMLLPKYEEREFVPRDL

SEQ ID NO: 4031 - protein, 193 aa, Unknown; identical to SEQ ID NO: 4027
  Description of Unknown: uncultivated organism with predicted taxonomy: Verrucomicrobia bacterium
  MG2-80 HNH domain

SEQ ID NO: 4032 - protein, 185 aa, Unknown
  Description of Unknown: uncultivated organism with predicted taxonomy: Verrucomicrobia bacterium
  MG2-81 HNH domain
DLREMSGKSAKEIQQDLGRRLANHHGVAAKLDADLDGRTFNGKPIQITAGLIRKARIAEDLGWTCPYTGKTYDAIDLVSRQVDKDHIIPRSLRPSDSLDSLVVTFAEVNKMKGQRTAWKFVSDEQGKVVEGSPQLSIVSLTRFKQWAESLETYKGHDDDKRRKKKRKELLLLPNYEEKGFVPRDL

SEQ ID NO: 4033 - protein, 193 aa, Unknown; identical to SEQ ID NO: 4027
  Description of Unknown: uncultivated organism with predicted taxonomy: Verrucomicrobia bacterium
  MG2-82 HNH domain

SEQ ID NO: 4034 - protein, 182 aa, Unknown
  Description of Unknown: uncultivated organism
  MG2-83 HNH domain
DLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDL

SEQ ID NO: 4035 - protein, 187 aa, Unknown; identical to SEQ ID NO: 3960
  Description of Unknown: uncultivated organism with predicted taxonomy: Verrucomicrobia bacterium
  MG2-84 HNH domain

SEQ ID NO: 4036 - protein, 193 aa, Unknown; identical to SEQ ID NO: 4027
  Description of Unknown: uncultivated organism with predicted taxonomy: Verrucomicrobia bacterium
  MG2-85 HNH domain

SEQ ID NO: 4037 - protein, 187 aa, Unknown; identical to SEQ ID NO: 3960
  Description of Unknown: uncultivated organism
  MG2-86 HNH domain

SEQ ID NO: 4038 - protein, 187 aa, Unknown; identical to SEQ ID NO: 3960
  Description of Unknown: uncultivated organism with predicted taxonomy: Methylococcales bacterium
  MG2-87 HNH domain

SEQ ID NO: 4039 - protein, 187 aa, Unknown; identical to SEQ ID NO: 3960
  Description of Unknown: uncultivated organism
  MG2-88 HNH domain

SEQ ID NO: 4040 - protein, 187 aa, Unknown; identical to SEQ ID NO: 3960
  Description of Unknown: uncultivated organism with predicted taxonomy: Verrucomicrobia
  MG2-89 HNH domain

SEQ ID NO: 4041 - protein, 182 aa, Unknown; identical to SEQ ID NO: 4034
  Description of Unknown: uncultivated organism with predicted taxonomy: Verrucomicrobia bacterium
  MG2-90 HNH domain

SEQ ID NO: 4042 - protein, 182 aa, Unknown; identical to SEQ ID NO: 4034
  Description of Unknown: uncultivated organism
  MG2-91 HNH domain

SEQ ID NO: 4043 - protein, 185 aa, Unknown
  Description of Unknown: uncultivated organism with predicted taxonomy: Verrucomicrobiae bacterium Tous-C5FEB
  MG2-92 HNH domain
DLREMSGKSSKEIQQDLGRRLANHHGVAAKLEKDLDGRTFNGKPIQITAGLIRKARIAEDLSWMCPYTSKAFDAIDLVSRQVDKDHIIPRSLRPSDSLDSLVVTFAEVNKMKGQRTALQFVSDEQGKTVEGSPQLSIVSLTRFKQWAESLETYKGHDDDKRRKKKRKELLLLQTYEEKGFVPRDL

SEQ ID NO: 4044 - protein, 185 aa, Unknown
  Description of Unknown: uncultivated organism
  MG2-94 HNH domain
ELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDL

SEQ ID NO: 4045 - protein, 185 aa, Unknown; identical to SEQ ID NO: 4044
  Description of Unknown: uncultivated organism
  MG2-95 HNH domain

SEQ ID NO: 4046 - protein, 185 aa, Unknown; identical to SEQ ID NO: 3956
  Description of Unknown: uncultivated organism
  MG2-96 HNH domain

SEQ ID NO: 4047 - protein, 185 aa, Unknown
  Description of Unknown: uncultivated organism with predicted taxonomy: Acidobacteria bacterium RIFCSPLOWO2_12_FULL_68_19
  MG2-97 HNH domain
ELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAFEAYVAKHTKQYRYGTDDRRRCERRAELMLMERYDQRNADFTERDL

SEQ ID NO: 4048 - protein, 186 aa, Unknown
  Description of Unknown: uncultivated organism with predicted taxonomy: Verrucomicrobia bacterium
  MG2-98 HNH domain
DLRTMSGMTAKERETEMKKRLSNFTSAKIALEKALTGKKIGGKPIPITAGLIRKARLAMDLDMTCPYTGQIYDFIDIAKGRMQRDHVIPYAERASDSLAAQVLTFAEVNKWKDKRTAAQFVREEQGKAVKGKPNLVVLPFEKYKAFVEGLDKGKHPHPDDKARKEKRKKLLLLEEYAEKEFLPADL

SEQ ID NO: 4049 - protein, 185 aa, Unknown; identical to SEQ ID NO: 3956
  Description of Unknown: uncultivated organism
  MG2-99 HNH domain

SEQ ID NO: 4050 - protein, 187 aa, Unknown
  Description of Unknown: uncultivated organism with predicted taxonomy: Proteobacteria
  MG2-100 HNH domain
ELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFICDCEKHGRDVPGHGNLQITTKKAYEAYVAKHKKQYRYGTDDRRRCERRAELMLMERYDQRNADFTERDL

SEQ ID NO: 4051 - protein, 185 aa, Unknown; identical to SEQ ID NO: 4044
  Description of Unknown: uncultivated organism with predicted taxonomy: Bradyrhizobium
  MG2-101 HNH domain

SEQ ID NO: 4052 - protein, 184 aa, Unknown
  Description of Unknown: uncultivated organism with predicted taxonomy: Methylococcales bacterium
  MG2-102 HNH domain
DLREMSGKTAKEKAQDLGLRIANHHAVAEKLEKAFAEERNGKSIRITAGLIRKARIADDLGWKCPYTGQPYEPKHLITRFVDKDHIVPRSDRASDSLDSLVITFSAINKWKGKRTAWQFVSEEQGKPVPDLPNFSILSLARYKQFVETLETYKGHDDDKRRKKKRKELMLLPKYEEKEFVPGDL

SEQ ID NO: 4053 - protein, 182 aa, Unknown
  Description of Unknown: uncultivated organism with predicted taxonomy: Verrucomicrobia bacterium
  MG2-103 HNH domain
DLREMSGKTAKEKAQDLGLRIANHHAVSDKLEKAFAEEGKRTPITAGLIRKARIADDLGWKCPYTGQDYEPKQLVSRYVDKDHIVPRSQRASDSLDSLVITFGAINKWKGNRTAWQFVEQEQSKPVPDLPNLSILTLTRYKQFVESLETYKGHDDDKRRKKRRKDLLLLPKYEEKTFVPRDL

SEQ ID NO: 4054 - protein, 180 aa, Unknown
  Description of Unknown: uncultivated organism with predicted taxonomy: Verrucomicrobia bacterium
  MG2-104 HNH domain
ELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDL

SEQ ID NO: 4055 - protein, 180 aa, Unknown; identical to SEQ ID NO: 4054
  Description of Unknown: uncultivated organism with predicted taxonomy: Verrucomicrobia bacterium
  MG2-105 HNH domain

SEQ ID NO: 4056 - protein, 155 aa, Unknown
  Description of Unknown: uncultivated organism with predicted taxonomy: Rothia
  MG3-6 HNH domain
TGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSL

SEQ ID NO: 4057 - protein, 159 aa, Unknown
  Description of Unknown: uncultivated organism with predicted taxonomy: Rothia
  MG3-7 HNH domain
TGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSL

SEQ ID NO: 4058 - protein, 155 aa, Unknown
  Description of Unknown: uncultivated organism with predicted taxonomy: Rothia
  MG3-8 HNH domain
IGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSL

SEQ ID NO: 4059 - protein, 156 aa, Unknown
  Description of Unknown: uncultivated organism with predicted taxonomy: Dermabacter hominis
  MG3-1 HNH domain
TGLMGAEQRSSIIAENNRNRRDSDRIRAELQADGLSEPSRLDVRRHRQVQRQNCTCLYCGTPITTTTSELDHIVPRRGGGSSQGSNLVAVCRECNASKAHRIFAEWAEDSQREGVSVKEAAKRVRHWLNASASMKREVTRRLQQKRTDPPIDERDL

SEQ ID NO: 4060 - protein, 163 aa, Unknown
  Description of Unknown: uncultivated organism with predicted taxonomy: Micrococcales
  MG3-5 HNH domain
TGLMGPAQRAEVLREMASGRRKNDRIRQELRTSGIDEPNLSDVKRHRKIQMQGGVCLYCGTDITSATAELDHIVPRAGGGNSTSTNLVAVCRVCNAAKGRRTFPEFASSDTRDAVSLEAAVERVKLWIDDKGIKNIGESRYARDVIRRLKQSTQDEPIDERSL

SEQ ID NO: 4061 - protein, 155 aa, Unknown
  Description of Unknown: uncultivated organism with predicted taxonomy: Rothia
  MG3-6 HNH domain
TGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSL

SEQ ID NO: 4062 - protein, 155 aa, Unknown
  Description of Unknown: uncultivated organism with predicted taxonomy: Rothia
  MG3-7 HNH domain
TGLVGPAQRQEILNEQKKNRENNELIRGDLRKSGVENPSRAEVRRHLIVQEQESQCLYCGAVIRTDTSELDHIVPRAGGGSSRRENMAAVCHYCNSKKKRTLFYDWAGPVKLQETVDRVRQLEAFKDSKKAKMFKNQIRRLKQTEADVPIDERSL

SEQ ID NO: 4063 - protein, 155 aa, Unknown; identical to SEQ ID NO: 4058
  Description of Unknown: uncultivated organism with predicted taxonomy: Rothia
  MG3-8 HNH domain

SEQ ID NO: 4064 - protein, 162 aa, Unknown
  Description of Unknown: uncultivated organism with predicted taxonomy: Brevibacterium
  MG3-42 HNH domain
SSLLGPAARAEYQREVNANRRARERSLESLREQGVADPTVATVRRFSAVQHQNGVCLYCGSAITAKPGDSGCELDHVVPRSGGGSSKRENLVAACRRCNSEKGNLPFSLWAAESTRPEVSVEAALTRLQNFNWERRDRAVKKGLIRRLKQTSEDEPIDERSL

SEQ ID NO: 4065 - protein, 162 aa, Unknown
  Description of Unknown: uncultivated organism with predicted taxonomy: Brevibacterium mcbrellneri
  MG3-68 HNH domain
SSLLGPAARAEYQREVNANRRARERSIESLREQGVADPTVATVRRFSAVQHQNGVCLYCGSTITAKPGDSGCELDHVVPRSGGGSSKRENLVAACRRCNSEKGNLPFSIWAATCTRPEVSVEAALVRLENFNWEKRDRAVKKGLIRRLKQTSEDEPIDERSL

SEQ ID NO: 4066 - protein, 162 aa, Unknown; identical to SEQ ID NO: 4064
  Description of Unknown: uncultivated organism with predicted taxonomy: Brevibacterium mcbrellneri
  MG3-88 HNH domain

SEQ ID NO: 4067 - protein, 158 aa, Unknown
  Description of Unknown: uncultivated organism with predicted taxonomy: Planctomycetes
  MG4-5 HNH domain
DMKRGRKQRKETWQAMRENERCRLDARKLLQDHGIQEPRPADILKVLLAEECNWECPYTGKAISMDALIGSQPQFDVEHIIPFSRSLDNSFLNKTLCYHEENRNVKQNRTPFEAYGGDEQRWHEILQRVRRFRGSAAESKLRKFQLRQLPADFTNRHL

SEQ ID NO: 4068 - protein, 159 aa, Unknown
  Description of Unknown: uncultivated organism
  MG4-11 HNH domain
DLKHNVKTKSKIIAQIKSREEEREAARKGLADLGIDNPTPANIKKWVIAERCNWTCVYTGKRADKRVEFGPHPQFDIDHIQPYSRSGNDSLGNKVLCFSAENRHVKKNQTPLECYGDDEERWNEIMGRVSAITGPDRVKTYRYFITTAEENEGFTARSL

SEQ ID NO: 4069 - protein, 161 aa, Unknown
  Description of Unknown: uncultivated organism
  MG4-12 HNH domain
DLKRSRKQRDEIFRKNQARKKERENIEKTLQNEFYIKSPKGRDVLKYRLWKECGGICPYTGMVISPDDLFGPNSRFDIEHIIPFSRSMDDSFANKTLCYAEENRNVKKNQTPIECYGDSPKFREILERVRKTFTGEFKFRKLKLFETQEPESITEFSKACL

SEQ ID NO: 4070 - protein, 158 aa, Unknown
  Description of Unknown: uncultivated organism
  MG4-13 HNH domain
EMKKTRQQREEIWKKNKQNEEKRKQAAQAIIKEAGENPKPADIEKYLLWDECNGICPYTGKSISLKQLFSGEVDVEHIIPYSICLDNSYFNKTLCFHDENAKVKNNKTPWQAYGSDEKKWNEILERVKRFKGDAAKEKLKKFQIKDLEELDDFISSQL

SEQ ID NO: 4071 - protein, 160 aa, Unknown
  Description of Unknown: uncultivated organism
  MG4-14 HNH domain
DLKKSKEDRKKISDQIARNRRDRERAKKALIDNGIQEPSRDDIEKWLLYEECNGICPYTGKSISLASLFGPNPQFDVEHIIPFSRCLDNSFTNKTLCDIEENRNRKRNQTPYEAYGADPARWEEIIQRVKRFRGKAAAAKLHRFQLESVDSLEEFASKQL

SEQ ID NO: 4072 - protein, 158 aa, Unknown
  Description of Unknown: uncultivated organism with predicted taxonomy: Thermogutta terrifontis
  MG4-15 HNH domain
ELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQL

SEQ ID NO: 4073 - protein, 158 aa, Unknown; identical to SEQ ID NO: 4072
  Description of Unknown: uncultivated organism with predicted taxonomy: Thermogutta terrifontis
  MG4-16 HNH domain

SEQ ID NO: 4074 - protein, 158 aa, Unknown
  Description of Unknown: uncultivated organism with predicted taxonomy: Thermogutta terrifontis
  MG4-17 HNH domain
ELKRSRKERAEISKRMREQQKRREEAAQKVLEELGRTATPRDIEKYLLAQECNWQCPYTGRQITVQSLLGDDPQFDVEHIWPLHRSLDDSFMNKTLCYHHENRSVKAGRTPYEAYATDPLRWQEILSRVRSFRGPFARQKLDRFQAVEIPPDFAMRQL

SEQ ID NO: 4075 - protein, 158 aa, Unknown
  Description of Unknown: uncultivated organism with predicted taxonomy: Thermogutta terrifontis
  MG4-18 HNH domain
ELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLDRFQAEEIPPDFALRQL

SEQ ID NO: 4076 - protein, 160 aa, Unknown
  Description of Unknown: uncultivated organism
  MG4-19 HNH domain
DLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQL

SEQ ID NO: 4077 - protein, 160 aa, Unknown; identical to SEQ ID NO: 4076
  Description of Unknown: uncultivated organism
  MG4-20 HNH domain

SEQ ID NO: 4078 - protein, 160 aa, Unknown; identical to SEQ ID NO: 4076
  Description of Unknown: uncultivated organism
  MG4-21 HNH domain

SEQ ID NO: 4079 - protein, 160 aa, Unknown; identical to SEQ ID NO: 4076
  Description of Unknown: uncultivated organism with predicted taxonomy: Planctomyces sp. SH-PL14
  MG4-22 HNH domain

SEQ ID NO: 4080 - protein, 160 aa, Unknown
  Description of Unknown: uncultivated organism
  MG4-23 HNH domain
DKKNPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQL

SEQ ID NO: 4081 - protein, 160 aa, Unknown; identical to SEQ ID NO: 4076
  Description of Unknown: uncultivated organism
  MG4-24 HNH domain

SEQ ID NO: 4082 - protein, 160 aa, Unknown; identical to SEQ ID NO: 4076
  Description of Unknown: uncultivated organism
  MG4-25 HNH domain

SEQ ID NO: 4083 - protein, 160 aa, Unknown; identical to SEQ ID NO: 4076
  Description of Unknown: uncultivated organism
  MG4-26 HNH domain

SEQ ID NO: 4084 - protein, 160 aa, Unknown; identical to SEQ ID NO: 4076
  Description of Unknown: uncultivated organism
  MG4-27 HNH domain

SEQ ID NO: 4085 - protein, 160 aa, Unknown; identical to SEQ ID NO: 4076
  Description of Unknown: uncultivated organism
  MG4-28 HNH domain

SEQ ID NO: 4086 - protein, 160 aa, Unknown; identical to SEQ ID NO: 4076
  Description of Unknown: uncultivated organism
  MG4-29 HNH domain

SEQ ID NO: 4087 - protein, 165 aa, Unknown
  Description of Unknown: uncultivated organism with predicted taxonomy: Alphaproteobacteria bacterium
  MG4-30 HNH domain
ELKKSKKQREAESKRNRENEAVRVKAKQTIKEITGDEHPSTDDVRRVQLFNDCRGTCVYCGETIAARNFLGRESQVDIDHIIPFSRSMDNSYANLVICHARCNRNKGDRTPFEAFSVDPESYGQIRDRVKIFAGDGRTVSEKIKRFEMDEGELEKFLGDFRNRQL

SEQ ID NO: 4088 - protein, 157 aa, Unknown
  Description of Unknown: uncultivated organism
  MG4-31 HNH domain
DLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHL

SEQ ID NO: 4089 - protein, 158 aa, Unknown
  Description of Unknown: uncultivated organism
  MG4-32 HNH domain
DLKSGRGRRERIANRMRDREKEREAAASAIAREIGVADPPRWMIEKHLLAEECGWRCPYTGKGFGIHDLLGRNSQFDLEHIWPFSRSLDNSYANKTICYHEENRNRKQGRTPAEAYSEEELQAILERVRAFKGDPFLIQAKLRRFTDPIEEGFTERHL

SEQ ID NO: 4090 - protein, 157 aa, Unknown; identical to SEQ ID NO: 4088
  Description of Unknown: uncultivated organism with predicted taxonomy: Insolitispirillum peregrinum
  MG4-33 HNH domain

SEQ ID NO: 4091 - protein, 161 aa, Unknown
  Description of Unknown: uncultivated organism with predicted taxonomy: Planctomycetes bacterium
  MG4-34 HNH domain
DLKRGRKEREKQSKRMAARRKQREEAKRRLLKETGIADPRRSDIERVLLADECNWICPFTGVKFGWSDLFGPTPRFDVEHIWPYSRSLDDSFLNKTICDQRENRTRKRNQTPHEAYGATPEVYERILQRVRAFSGDPWVLAAKLSRFEAESIPEGHVDRHL

SEQ ID NO: 4092 - protein, 158 aa, Unknown; identical to SEQ ID NO: 4089
  Description of Unknown: uncultivated organism
  MG4-35 HNH domain

SEQ ID NO: 4093 - protein, 166 aa, Unknown
  Description of Unknown: uncultivated organism with predicted taxonomy: Proteobacteria
  MG4-36 HNH domain
ELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRAL

SEQ ID NO: 4094 - protein, 166 aa, Unknown
  Description of Unknown: uncultivated organism with predicted taxonomy: Solemya velesiana gill symbiont
  MG4-37 HNH domain
ELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWNEILQRVEVFKGSYSKAKLNRFKMDESAVGELFEQFSSRAL

SEQ ID NO: 4095 - protein, 166 aa, Unknown
  Description of Unknown: uncultivated organism with predicted taxonomy: Acidobacteria
  MG4-38 HNH domain
ELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHL

SEQ ID NO: 4096 - protein, 159 aa, Unknown
  Description of Unknown: uncultivated organism with predicted taxonomy: Planctomycetes
  MG4-39 HNH domain
DLKKSRHERQQLSKGMRQQQKQREDARNWLQHEMGISNPTAHDILKYRLWIECEKLCPYTGKPISKEALFGSEPQFDVEHIIPYSRCLDNSFANKTLCEVAENRAAKKNRTPYEAYGNAPQRWHEILQRVSRFRGDAAKAKLRRFQLTEIPADFANRHL

SEQ ID NO: 4097 - protein, 159 aa, Unknown
  Description of Unknown: uncultivated organism with predicted taxonomy: Thermogutta terrifontis
  MG4-40 HNH domain
DIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHL

SEQ ID NO: 4098 - protein, 159 aa, Unknown
  Description of Unknown: uncultivated organism with predicted taxonomy: Planctomycetes
  MG4-41 HNH domain
DLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHL

SEQ ID NO: 4099 - protein, 159 aa, Unknown; identical to SEQ ID NO: 4097
  Description of Unknown: uncultivated organism with predicted taxonomy: Thermogutta terrifontis
  MG4-42 HNH domain

SEQ ID NO: 4100 - protein, 159 aa, Unknown; identical to SEQ ID NO: 4097
  Description of Unknown: uncultivated organism
  MG4-43 HNH domain

SEQ ID NO: 4101 - protein, 170 aa, Unknown
  Description of Unknown: uncultivated organism with predicted taxonomy: Proteobacteria
  MG4-44 HNH domain
EMKQSRIQRQKRYQTMRDREKMRNQARQSLQAELGWDPNDIKGRDIEKWLLAEECSWVCPYSGKPINYHNLFGEKAEFDIEHIIPYSKSLDDSFVNKTLCHREWNQKKGNRTPAQAFKNTPEWEAMLQRVRAFKPLHAVHMKKGESSKRNPKYDLFCMEEIPPDYVDNKL

SEQ ID NO: 4102 - protein, 170 aa, Unknown; identical to SEQ ID NO: 4101
  Description of Unknown: uncultivated organism
  MG4-45 HNH domain

SEQ ID NO: 4103 - protein, 159 aa, Unknown; identical to SEQ ID NO: 4097
  Description of Unknown: uncultivated organism
  MG4-46 HNH domain

SEQ ID NO: 4104 - protein, 166 aa, Unknown
  Description of Unknown: uncultivated organism with predicted taxonomy: Proteobacteria
  MG4-47 HNH domain
ELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRAL

SEQ ID NO: 4105 - protein, 160 aa, Unknown
  Description of Unknown: uncultivated organism
  MG4-48 HNH domain
DLRRPLCEVREMIKQMRKREKMRREAERKLCEEHGIRKPTAREIEKYLLWKECNARCPYTNQDIRAEALFGSHPRFDVEHIIPWSRCLDDSFANKTLCEAKHNREQKRNRMPTEAYSREALEQIWERVRRFQGDYAAEKLRRFQMDPPPELHLIHRGDQL

SEQ ID NO: 4106 - protein, 159 aa, Unknown; identical to SEQ ID NO: 4098
  Description of Unknown: uncultivated organism
  MG4-49 HNH domain

SEQ ID NO: 4107 - protein, 166 aa, Unknown
  Description of Unknown: uncultivated organism with predicted taxonomy: Solemya velesiana gill symbiont
  MG4-51 HNH domain
ELRKSREEREKDSKRMREHEKEREAIIRRICEEIGIPETGISRDDVRKAMLWEECNGMCPYSGRSLGGFASLFSGNSPAQIEHIIPFSRSLDNSFVNLTLAHVSENAYKGDKTPWEAYGSNPEQWDRILQRVALFKGSYKKAKLNRFKMDSNAVGEFLEQFSSRAL

SEQ ID NO: 4108 - protein, 166 aa, Unknown
  Description of Unknown: uncultivated organism
  MG4-52 HNH domain
ELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQWVEVFKGSYSKAKLNRFKMDESAVGELFEQFSSRAL

SEQ ID NO: 4109 - protein, 161 aa, Unknown
  Description of Unknown: uncultivated organism
  MG4-53 HNH domain
EVKKNARQRHQIALRNRENERLRRAAAERIVREVGIANPSRADIEKVLLAEECNWHCPYTGKPISMAALFGEHPQFDVEHIIPFARSLDDSFMNKTLCDAEENRRVKRGRTPFEAYGSQPERWAEILRRVRAFKGSAADAKLERFRCESPPDATELCSRLL

SEQ ID NO: 4110 - protein, 166 aa, Unknown; identical to SEQ ID NO: 4095
  Description of Unknown: uncultivated organism
  MG4-54 HNH domain

SEQ ID NO: 4111 - protein, 170 aa, Unknown
  Description of Unknown: uncultivated organism with predicted taxonomy: Flavobacterium hercynium
  MG4-55 HNH domain
EMKQSRIQRQKRYQTMRDREKMRNQARQSLQAELGWDPNDIKGRDIEKWLLAEECGWVCPYSGKPINYHNLFGEKAEFDIEHIIPYSKSLDDSFVNKTLCHREWNQKKGNRTPAQAFKNTPEWETMLQRVRAFKPLHAVHMKKGESSKHNPKYDLFCMEEIPPDYVDNKL

SEQ ID NO: 4112 - protein, 166 aa, Unknown; identical to SEQ ID NO: 4093
  Description of Unknown: uncultivated organism with predicted taxonomy: Pseudoxanthobacter soli
  MG4-56 HNH domain

SEQ ID NO: 4113 - protein, 161 aa, Unknown
  Description of Unknown: uncultivated organism with predicted taxonomy: candidate division Zixibacteria bacterium CG_4_9_14_3_um_filter_46_8
  MG4-57 HNH domain
DLKRSKKQRQTLTERIRSREKLREDARKRLENEKLVERPTRNDIDKVLLADECNWICPYTGRQIGWKTLFGPSPQFDIEHIIPFSRCLDDSLANKTLCDIEENRNVKRNRTPWEAYGSNPEKWGQILDRVRRFKGDDAILKLQRFQLKDVGDFEEFSSRQL

SEQ ID NO: 4114 - protein, 166 aa, Unknown
  Description of Unknown: uncultivated organism
  MG4-58 HNH domain
ELRKSREERMKESRRMRDREKEREEIIRRIRDEVGIPEEKISRDDVLKGLLWQECEGRCPYCGESLGGFASLFGGNPPAQIEHIIPFSRSLDNSFVNLTLAHVSDNAYKGDRTPREAYGSDPERWNEILQRVEVFKGSYSKAKLNRFKMDESAVGELFEQFSSRAL

SEQ ID NO: 4115 - protein, 166 aa, Unknown; identical to SEQ ID NO: 4104
  Description of Unknown: uncultivated organism with predicted taxonomy: Proteobacteria
  MG4-60 HNH domain

SEQ ID NO: 4116 - protein, 159 aa, Unknown; identical to SEQ ID NO: 4097
  Description of Unknown: uncultivated organism with predicted taxonomy: Thermogutta terrifontis
  MG4-61 HNH domain

SEQ ID NO: 4117 - protein, 162 aa, Unknown
  Description of Unknown: uncultivated organism
  MG4-62 HNH domain
DLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHL

SEQ ID NO: 4118 - protein, 157 aa, Unknown
  Description of Unknown: uncultivated organism with predicted taxonomy: Planctomyces sp. SH-PL14
  MG4-63 HNH domain
DLKNSRSRRADLTTRRNRNQARRERAKEAIEKECNNSRPSRFDIEKWLLAEECGFQCPYTGQSIPRHRVLSAEFEVEHIVPFSRSLDNSFTNKTLSHRDANAKKGNRTPMEAFGQPEEKWEQILARVKRFDGPFARRKLDLFQQRTPPEADFYERQL

SEQ ID NO: 4119 - protein, 162 aa, Unknown; identical to SEQ ID NO: 4117
  Description of Unknown: uncultivated organism
  MG4-64 HNH domain

SEQ ID NO: 4120 - protein, 159 aa, Unknown
  Description of Unknown: uncultivated organism
  MG4-65 HNH domain
DLKRPRKQREEISKRNRGRQKDREEAAEAIRSALPGLEPRRADIEKWLLAEECNWRCPYTGRSINAAALLGSTPQFDVEHIWPMSRSLDNTFANKTLCYHEENRARKGNRTPLEAYGSDPQRWEEILQSVRRFNGPLAWEKLRRFMAREIPQDFTDRQL

SEQ ID NO: 4121 - protein, 159 aa, Unknown
  Description of Unknown: uncultivated organism
  MG4-66 HNH domain
DLKKSRYERQQLFKGMRQQQKQREEAKSWLQCQMGITNPTAHDILKYRLWIECNQQCPYTGKPISKEALFGREPQFDVEHIIPFSRCLDNSFTNKTLCEIAENRNVKKNRTPYEAYGHDPQRWHEILQRVSRFQGDAAKAKLRRFQLTEIPADFANRHL

SEQ ID NO: 4122 - protein, 159 aa, Unknown
  Description of Unknown: uncultivated organism with predicted taxonomy: Proteobacteria
  MG4-67 HNH domain
DLKRSRKDRQELSKVIRENEKLREKAKERILRELGDQQPTRADIEKVLLAEECGWECPYTGKRFGMQELLGQNPQFDVEHIIPLSRSLDNSFGNKTLCYHEENRNHKRNRTPWEAYHADEQRWHQILERVRRFQGASARGKMRRFLMEAIPDDFTSRQL

SEQ ID NO: 4123 - protein, 158 aa, Unknown
  Description of Unknown: uncultivated organism with predicted taxonomy: Thermogutta terrifontis
  MG4-68 HNH domain
ELKLGKKRRQELAKEMRKREAERERAAKVIEETLHRKARPNEILKYLLADECDWECPYTGKKISVLTLLGDQPQFDVEHIWPFDRTLDDSFGNKTLCYHEENRQVKGNKTPFEAYSDSPDRWREILERVKRFKGPFAKEKLRRFLAADIPQDFPMRHL

SEQ ID NO: 4124 - protein, 166 aa, Unknown
  Description of Unknown: uncultivated organism with predicted taxonomy: Planctomycetes bacterium
  MG4-70 HNH domain
ELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRAL

SEQ ID NO: 4125 - protein, 165 aa, Unknown
  Description of Unknown: uncultivated organism
  MG4-71 HNH domain
DLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHL

SEQ ID NO: 4126 - protein, 167 aa, Unknown
  Description of Unknown: uncultivated organism with predicted taxonomy: Acidobacteria
  MG4-72 HNH domain
DLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQL

SEQ ID NO: 4127 - protein, 165 aa, Unknown; identical to SEQ ID NO: 4125
  Description of Unknown: uncultivated organism
  MG4-73 HNH domain

SEQ ID NO: 4128 - protein, 167 aa, Unknown; identical to SEQ ID NO: 4126
  Description of Unknown: uncultivated organism with predicted taxonomy: Acidobacteria
  MG4-74 HNH domain

SEQ ID NO: 4129 - protein, 166 aa, Unknown; identical to SEQ ID NO: 4124
  Description of Unknown: uncultivated organism with predicted taxonomy: Proteobacteria
  MG4-76 HNH domain

SEQ ID NO: 4130 - protein, 166 aa, Unknown
  Description of Unknown: uncultivated organism
  MG4-77 HNH domain
ELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHL

SEQ ID NO: 4131 - protein, 162 aa, Unknown
  Description of Unknown: uncultivated organism
  MG4-78 HNH domain
ELRKPLRRLRELLRRNEERQRQRKHAIKYLIEKGIQDPRPDQIEKFLLWVECKQICPYTGQSISDVDLFGPLPRFDVEHIIPWSRCLDDSFANKTLCEVDHNRNRKRNRMPTEVYSQDELSQILRRVRAFQGPYRFEKLRRFQMTEADLTTETGWLLRGDQL

SEQ ID NO: 4132 - protein, 162 aa, Unknown; identical to SEQ ID NO: 4131
  Description of Unknown: uncultivated organism
  MG4-79 HNH domain

SEQ ID NO: 4133 - protein, 161 aa, Unknown
  Description of Unknown: uncultivated organism with predicted taxonomy: Planctomycetes
  MG4-80 HNH domain
DLRRSRKEREKISAEQAKREKARRDALQKMLREFPNYQPKRGYDPAIEKILLAEECDWECPFTGKKINMQTLLGKSPQFDVAHIYPRRYLDDSFANKTLCYHEENRHRMLDRLPMEAYAGNPQRWQEILARVKRFQGPYAAEKLRRFQTEKVPDDFVSRQL

SEQ ID NO: 4134 - protein, 166 aa, Unknown; identical to SEQ ID NO: 4130
  Description of Unknown: uncultivated organism with predicted taxonomy: Rhodobacteraceae
  MG4-81 HNH domain

SEQ ID NO: 4135 - protein, 158 aa, Unknown
  Description of Unknown: uncultivated organism
  MG4-82 HNH domain
DLKQPRKVREERSKSMRKNEALRQQIIDDIRRFGIANPSETDILKVRLADECNWQCPYTGKAISMETLLGPHPQFDIEHIQPYSRSLDNSFTNKTLCDVHENRIAKRNLTPFEAYSGDEQRWHEIIARVRRFRGPASPAKLRKFLAKAIDSDFVERQL

SEQ ID NO: 4136 - protein, 164 aa, Unknown
  Description of Unknown: uncultivated organism
  MG4-83 HNH domain
DMKRPRKARQQISKRIRANKNKRDAARQQLLKEASGALGSAWEPKRSDIEKWLLRDECGGICPYTGKPISFHSLFVEPEFDIEHIIPFSRSLDNSFLNKTLCCATENRIKSKRTPWEAYGGTARWDEIIGRVRKFTGDANVAKLQRFQIRDADKEIDGFAAREL

SEQ ID NO: 4137 - protein, 161 aa, Unknown
  Description of Unknown: uncultivated organism
  MG4-84 HNH domain
DLRKSPKQREQTWKKNRDNEALRKDAAEKLFREMGIQNPKRSDIEKMLLLQECGCMCPYTGKHISMRDLFGDAPQFDVEHIVPFSRSLDDSFLNKTLCEVAENRNVKGNRTPWEAYGHDLVRWNQILQRVSHFQGSAQREKLRRFQLQTIESPEQFASSQL

SEQ ID NO: 4138 - protein, 162 aa, Unknown; identical to SEQ ID NO: 4131
  Description of Unknown: uncultivated organism
  MG4-85 HNH domain

SEQ ID NO: 4139 - protein, 162 aa, Unknown; identical to SEQ ID NO: 4131
  Description of Unknown: uncultivated organism
  MG4-86 HNH domain

SEQ ID NO: 4140 - protein, 161 aa, Unknown
  Description of Unknown: uncultivated organism
  MG4-87 HNH domain
DLKHGRDRRAAITKQIRQREKQHADAKHRILAEIKGYEPTRIDREKVLLADECDWRCPYTGKKFGMKELIGEHPQVDVEHIWPFSRSFDNSFMNKTLCWHDENRRVKRGRTPYEAYSASPERYQEILGRVLAFKSDRRTVSEKFRRFTAEAIDEDFTNRHL

SEQ ID NO: 4141 - protein, 161 aa, Unknown
  Description of Unknown: uncultivated organism with predicted taxonomy: Planctomycetes bacterium
  MG4-88 HNH domain
DLRRSRKDRKRIAEQQREQETRRRKALERMMREFPNYQAKAGFDPAIEKILLAEECNWECPFTGRKIEMATLLGKNAQFDVAHLFPRRYLDDSFLNKTLCYHDENRHRMHDLLPKQAYGGDPQRWAEIIARVKAFKGSAATLKLERFLAAEVPEDFVESQL

SEQ ID NO: 4142 - protein, 161 aa, Unknown
  Description of Unknown: uncultivated organism with predicted taxonomy: Planctomicrobium piriforme
  MG4-89 HNH domain
DLKRARKQRERLSKEMREQEARRDSARAAIVRKAGLAGPSRSDIERYILAEECGFICPYTGKPMDRERLTDLVGRTPQFDVEHIWPLSRSLDDSYLNKTLCHVEENKAKGNRTPFEAYSQSPERWEQILDRVKRFGGTAARIKLERFTAKEIPDGFAERHL

SEQ ID NO: 4143 - protein, 162 aa, Unknown; identical to SEQ ID NO: 4117
  Description of Unknown: uncultivated organism
  MG4-90 HNH domain

SEQ ID NO: 4144 - protein, 166 aa, Unknown
  Description of Unknown: uncultivated organism with predicted taxonomy: Deltaproteobacteria bacterium
  MG4-91 HNH domain
ELKHGRSRREQTERRMRERAKQREAAAETIIRETTARGFRIDKPRRDDIEKYLLAEECGWICPYTGRSIGWESLFGPHPEFDIEHIWPFSRSLDNRFLNKRLCHAATNRSVKKNRTPYEAFGQDTEQWEQILDRVRRFKGDPYARREKLRRFEAQEIDEGFLERHL

SEQ ID NO: 4145 - protein, 158 aa, Unknown
  Description of Unknown: uncultivated organism with predicted taxonomy: Alphaproteobacteria
  MG4-92 HNH domain
DIKLGRKRRAEISKKMRTRQSEREDAKEQLRQWGVPVTHDAIERELLRRECNGVCPYTGREISPSQLFGESPQFDIEHIIPYSRSLDNSFANKTLCWHATNRNRKRGKTPYEVFSQDGDWEVILRRVAAFKGGYRDEKLRRFKLADLSEFDDFERRQL

SEQ ID NO: 4146 - protein, 158 aa, Unknown
  Description of Unknown: uncultivated organism with predicted taxonomy: Proteobacteria
  MG4-93 HNH domain
DIKLGRKRRAEISKKMRTRQSEREDAKEQLRQWGVPVTRDAIERELLRRECNGVCPYTGREISPSHLFGESPQFDIEHIIPYSRSLDNSFANKTLCWHATNRNRKRGKTPYEVFSQDGDWEVILRRVAAFKGGYRDEKLRRFKLADLSEFDDFERRQL

SEQ ID NO: 4147 - protein, 165 aa, Unknown
  Description of Unknown: uncultivated organism with predicted taxonomy: Planctomycetales bacterium 4484_113
  MG4-94 HNH domain
DVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQL

SEQ ID NO: 4148 - protein, 161 aa, Unknown
  Description of Unknown: uncultivated organism with predicted taxonomy: Planctomycetes bacterium
  MG4-95 HNH domain
DLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQL

SEQ ID NO: 4149 - protein, 165 aa, Unknown; identical to SEQ ID NO: 4147
  Description of Unknown: uncultivated organism with predicted taxonomy: Planctomycetales bacterium 4484_113
  MG4-96 HNH domain

SEQ ID NO: 4150 - protein, 164 aa, Unknown
  Description of Unknown: uncultivated organism with predicted taxonomy: Planctomycetes bacterium
  MG4-97 HNH domain
DLKAPKQIRLRRSRQMRRNEAERKSARKELIEQGLPEPTGRDIEKYRLWKECGKRCPYTGKMISFSDLFGPHPKFDIEHIIPWHRCLLDSFANKTLCEVQENRSRKGNRTPYEAYSGDPDRYEEIKQRVREFTGPFGKAKLRRFRCEDIQKLPESLPLYGGEQL

SEQ ID NO: 4151 - protein, 163 aa, Unknown
  Description of Unknown: uncultivated organism
  MG4-98 HNH domain
ELKQSPKQRQETTKRMRRNEKERNDIREQIRNETGIENPTYTDILKVRLAKECNWECPYTGTHISMQQLIGPHPQFDIEHIIPHYRSLDNSFTNLTLCEARENREVKRNRTPYEAYHDTAKWEDIIRRVERFDGPMRNAKLRRFLLQGEELEKFLDGFTNRQL

SEQ ID NO: 4152 - protein, 161 aa, Unknown; identical to SEQ ID NO: 4148
  Description of Unknown: uncultivated organism with predicted taxonomy: Planctomycetes bacterium
  MG4-99 HNH domain

SEQ ID NO: 4153 - protein, 161 aa, Unknown; identical to SEQ ID NO: 4148
  Description of Unknown: uncultivated organism with predicted taxonomy: Planctomycetes bacterium
  MG4-100 HNH domain

SEQ ID NO: 4154 - protein, 163 aa, Unknown; identical to SEQ ID NO: 4151
  Description of Unknown: uncultivated organism
  MG4-101 HNH domain

SEQ ID NO: 4155 - protein, 163 aa, Unknown
  Description of Unknown: uncultivated organism
  MG4-102 HNH domain
EMKLSANRKKEIIKRNRDLEKQREKAAEKIRDVFPGMTPGRTDTTKVLLAEECGWRCPYTGRSISIRTLFGPHPQFDIEHIIPRSRSLDDSFLNKTLCYHEENRNVKRNRTPYEAYHGTPRYDEILDRVAKFNGRLAKEKLRRFRMTPEEVEDRFADFTQRQL

SEQ ID NO: 4156 - protein, 163 aa, Unknown; identical to SEQ ID NO: 4155
  Description of Unknown: uncultivated organism
  MG4-103 HNH domain

SEQ ID NO: 4157 - protein, 156 aa, Unknown
  Description of Unknown: uncultivated organism with predicted taxonomy: Planctomycetes bacterium
  MG4-104 HNH domain
DLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNL

SEQ ID NO: 4158 - protein, 156 aa, Unknown
  Description of Unknown: uncultivated organism
  MG4-105 HNH domain
DLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNL

SEQ ID NO: 4159 - protein, 156 aa, Unknown
  Description of Unknown: uncultivated organism
  MG4-106 HNH domain
DLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNL

SEQ ID NO: 4160 - protein, 156 aa, Unknown; identical to SEQ ID NO: 4159
  Description of Unknown: uncultivated organism
  MG4-107 HNH domain

SEQ ID NO: 4161 - protein, 156 aa, Unknown; identical to SEQ ID NO: 4158
  Description of Unknown: uncultivated organism
  MG4-108 HNH domain

SEQ ID NO: 4162 - protein, 156 aa, Unknown; identical to SEQ ID NO: 4157
  Description of Unknown: uncultivated organism with predicted taxonomy: Planctomycetes bacterium
  MG4-109 HNH domain

SEQ ID NO: 4163 - protein, 156 aa, Unknown
  Description of Unknown: uncultivated organism
  MG4-110 HNH domain
DLKNSSKDRENIARRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKLQKAESRDFIERNL

SEQ ID NO: 4164 - protein, 156 aa, Unknown
  Description of Unknown: uncultivated organism with predicted taxonomy: Planctomycetes bacterium
  MG4-111 HNH domain
DLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYAEIIERVRHFKGSFAKIKLEKFELETAEVQDFINRNL

SEQ ID NO: 4165 - protein, 156 aa, Unknown; identical to SEQ ID NO: 4158
  Description of Unknown: uncultivated organism
  MG4-112 HNH domain

SEQ ID NO: 4166 - protein, 156 aa, Unknown; identical to SEQ ID NO: 4159
  Description of Unknown: uncultivated organism
  MG4-113 HNH domain

SEQ ID NO: 4167 - protein, 156 aa, Unknown; identical to SEQ ID NO: 4158
  Description of Unknown: uncultivated organism
  MG4-114 HNH domain

SEQ ID NO: 4168 - protein, 156 aa, Unknown; identical to SEQ ID NO: 4158
  Description of Unknown: uncultivated organism
  MG4-115 HNH domain

SEQ ID NO: 4169 - protein, 159 aa, Unknown
  Description of Unknown: uncultivated organism
  MG4-116 HNH domain
DLKKPRQERARATDLNRKRQRERDSVKERIVREGGLERPSRDDIEKVLLWEECGGICPYTGKSIAFASLFGEHPQFGVEHIIPFSRLPDNSFQNKTLCDHEQGRNVKRNKTPFEAYPNTEEYDAILTRIKAWETPNLGKQKRFELRTLEELEGFSTRQL

SEQ ID NO: 4170 - protein, 157 aa, Unknown
  Description of Unknown: uncultivated organism with predicted taxonomy: Acidobacteriales bacterium 59-55
  MG4-117 HNH domain
ELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQM

SEQ ID NO: 4171 - protein, 159 aa, Unknown; identical to SEQ ID NO: 4169
  Description of Unknown: uncultivated organism
  MG4-118 HNH domain

SEQ ID NO: 4172 - protein, 157 aa, Unknown; identical to SEQ ID NO: 4170
  Description of Unknown: uncultivated organism
  MG4-119 HNH domain

SEQ ID NO: 4173 - protein, 159 aa, Unknown; identical to SEQ ID NO: 4169
  Description of Unknown: uncultivated organism
  MG4-120 HNH domain

SEQ ID NO: 4174 - protein, 157 aa, Unknown
  Description of Unknown: uncultivated organism with predicted taxonomy: Acidobacteriales bacterium 59-55
  MG4-121 HNH domain
ELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMSRFAIQTEEALGDFSARQM

SEQ ID NO: 4175 - protein, 157 aa, Unknown
  Description of Unknown: uncultivated organism with predicted taxonomy: uncultured bacterium
  MG4-122 HNH domain
ELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQM

SEQ ID NO: 4176 - protein, 159 aa, Unknown; identical to SEQ ID NO: 4169
  Description of Unknown: uncultivated organism
  MG4-123 HNH domain

SEQ ID NO: 4177 - protein, 159 aa, Unknown; identical to SEQ ID NO: 4169
  Description of Unknown: uncultivated organism
  MG4-124 HNH domain

SEQ ID NO: 4178 - protein, 159 aa, Unknown; identical to SEQ ID NO: 4169
  Description of Unknown: uncultivated organism
  MG4-125 HNH domain

SEQ ID NO: 4179 - protein, 160 aa, Unknown
  Description of Unknown: uncultivated organism
  MG4-126 HNH domain
DLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQL

SEQ ID NO: 4180 - protein, 157 aa, Unknown; identical to SEQ ID NO: 4175
  Description of Unknown: uncultivated organism
  MG4-127 HNH domain

SEQ ID NO: 4181 - protein, 157 aa, Unknown; identical to SEQ ID NO: 4170
  Description of Unknown: uncultivated organism with predicted taxonomy: Acidobacteriales bacterium 59-55
  MG4-128 HNH domain

SEQ ID NO: 4182 - protein, 160 aa, Unknown
  Description of Unknown: uncultivated organism
  MG4-129 HNH domain
ELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQL

SEQ ID NO: 4183 - protein, 161 aa, Unknown
  Description of Unknown: uncultivated organism with predicted taxonomy: Planctomycetes
  MG4-130 HNH domain
DLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARML

SEQ ID NO: 4184 - protein, 157 aa, Unknown; identical to SEQ ID NO: 4170
  Description of Unknown: uncultivated organism
  MG4-131 HNH domain

SEQ ID NO: 4185 - protein, 165 aa, Unknown
  Description of Unknown: uncultivated organism with predicted taxonomy: Planctomycetes bacterium
  MG4-132 HNH domain
ELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQL

SEQ ID NO: 4186 - protein, 160 aa, Unknown; identical to SEQ ID NO: 4179
  Description of Unknown: uncultivated organism
  MG4-133 HNH domain

SEQ ID NO: 4187 - protein, 157 aa, Unknown; identical to SEQ ID NO: 4170
  Description of Unknown: uncultivated organism with predicted taxonomy: Acidobacteriales bacterium 59-55
  MG4-134 HNH domain

SEQ ID NO: 4188 - protein, 157 aa, Unknown; identical to SEQ ID NO: 4170
  Description of Unknown: uncultivated organism with predicted taxonomy: Acidobacteriales bacterium 59-55
  MG4-135 HNH domain

SEQ ID NO: 4189 - protein, 157 aa, Unknown; identical to SEQ ID NO: 4170
  Description of Unknown: uncultivated organism with predicted taxonomy: Acidobacteriales bacterium 59-55
  MG4-136 HNH domain

SEQ ID NO: 4190 - protein, 165 aa, Unknown; identical to SEQ ID NO: 4185
  Description of Unknown: uncultivated organism with predicted taxonomy: Acidobacteriales bacterium 59-55
  MG4-137 HNH domain

SEQ ID NO: 4191 - protein, 160 aa, Unknown
  Description of Unknown: uncultivated organism with predicted taxonomy: uncultured bacterium
  MG4-138 HNH domain
DLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQL

SEQ ID NO: 4192 - protein, 158 aa, Unknown
  Description of Unknown: uncultivated organism
  MG4-139 HNH domain
ELKKSRRERMESVSTNRDREKQRNAAKEKLLKELGLQHPSRADIEKALLWEECQGVCPYTGKQFPFSSLFGENPSMQVQHIIPFSRIPDDSFQNKTLCSVEENQYKANRTPFEAYADPAQYEAILDRVKNWPRPNRGKQRRFELRTLEELEGFSSRQL

SEQ ID NO: 4193 - protein, 168 aa, Unknown
  Description of Unknown: uncultivated organism with predicted taxonomy: Planctomycetes bacterium
  MG4-140 HNH domain
ELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRL

SEQ ID NO: 4194 - protein, 160 aa, Unknown; identical to SEQ ID NO: 4179
  Description of Unknown: uncultivated organism
  MG4-141 HNH domain

SEQ ID NO: 4195 - protein, 160 aa, Unknown; identical to SEQ ID NO: 4182
  Description of Unknown: uncultivated organism with predicted taxonomy: Polaribacter sp. ALD11
  MG4-142 HNH domain

SEQ ID NO: 4196 - protein, 157 aa, Unknown; identical to SEQ ID NO: 4170
  Description of Unknown: uncultivated organism
  MG4-143 HNH domain

SEQ ID NO: 4197 - protein, 157 aa, Unknown; identical to SEQ ID NO: 4175
  Description of Unknown: uncultivated organism
  MG4-144 HNH domain

SEQ ID NO: 4198 - protein, 160 aa, Unknown; identical to SEQ ID NO: 4179
  Description of Unknown: uncultivated organism
  MG4-145 HNH domain

SEQ ID NO: 4199 - protein, 157 aa, Unknown; identical to SEQ ID NO: 4170
  Description of Unknown: uncultivated organism with predicted taxonomy: Acidobacteriales bacterium 59-55
  MG4-146 HNH domain

SEQ ID NO: 4200 - protein, 160 aa, Unknown; identical to SEQ ID NO: 4179
  Description of Unknown: uncultivated organism
  MG4-147 HNH domain

SEQ ID NO: 4201 - protein, 157 aa, Unknown; identical to SEQ ID NO: 4170
  Description of Unknown: uncultivated organism
  MG4-148 HNH domain

SEQ ID NO: 4202 - protein, 157 aa, Unknown; identical to SEQ ID NO: 4170
  Description of Unknown: uncultivated organism
  MG4-149 HNH domain

SEQ ID NO: 4203 - protein, 160 aa, Unknown
  Description of Unknown: uncultivated organism with predicted taxonomy: Polaribacter sp. ALD11
  MG4-150 HNH domain
ELKKPRSKRLDETARNRKREAENKALAERMHNECGMPQNSSRNDLEKAKLWVEQQGQCPYTGRSLPFSRLFDDNNGFDVDHILPRSRHPDDSYQNKVLCWGDTNRMVKRNQTPYEAFAEQDPENWHQILARVARWKNPGKSRKFEIRSTDELAEFSSRQL

SEQ ID NO: 4204 - protein, 165 aa, Unknown; identical to SEQ ID NO: 4185
  Description of Unknown: uncultivated organism with predicted taxonomy: Acidobacteriales
  MG4-151 HNH domain

SEQ ID NO: 4205 - protein, 160 aa, Unknown; identical to SEQ ID NO: 4179
  Description of Unknown: uncultivated organism
  MG4-152 HNH domain

SEQ ID NO: 4206 - protein, 157 aa, Unknown; identical to SEQ ID NO: 4170
  Description of Unknown: uncultivated organism
  MG4-153 HNH domain

SEQ ID NO: 4207 - protein, 157 aa, Unknown
  Description of Unknown: uncultivated organism with predicted taxonomy: Acidobacteriales bacterium 59-55
  MG4-154 HNH domain
ELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQM

SEQ ID NO: 4208 - protein, 161 aa, Unknown
  Description of Unknown: uncultivated organism with predicted taxonomy: Deltaproteobacteria
  MG4-155 HNH domain
DLKASRPEREDRWARMRRNEKARAEAAAKIQSEIGIHTPGRADTEKWLLAEECHWRCPYSGRGFSATQLYQSGEIQVEHIIPFSRSLDDSFANKTLAYSWVNKAKGNRSPREAFQEQSQWEAILTEVGSFHGPYAKHKLQRFQWTSEQIAELLDDFTKRQL

SEQ ID NO: 4209 - protein, 163 aa, Unknown
  Description of Unknown: uncultivated organism with predicted taxonomy: Planctomycetes bacterium
  MG4-156 HNH domain
ELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQL

SEQ ID NO: 4210 - protein, 157 aa, Unknown; identical to SEQ ID NO: 4170
  Description of Unknown: uncultivated organism
  MG4-157 HNH domain

SEQ ID NO: 4211 - protein, 157 aa, Unknown; identical to SEQ ID NO: 4170
  Description of Unknown: uncultivated organism
  MG4-158 HNH domain

SEQ ID NO: 4212 - protein, 157 aa, Unknown; identical to SEQ ID NO: 4170
  Description of Unknown: uncultivated organism with predicted taxonomy: Acidobacteriales bacterium 59-55
  MG4-159 HNH domain

SEQ ID NO: 4213 - protein, 161 aa, Unknown; identical to SEQ ID NO: 4183
  Description of Unknown: uncultivated organism with predicted taxonomy: Planctomycetes
  MG4-160 HNH domain

SEQ ID NO: 4214 - protein, 157 aa, Unknown; identical to SEQ ID NO: 4170
  Description of Unknown: uncultivated organism with predicted taxonomy: Acidobacteriales bacterium 59-55
  MG4-161 HNH domain

SEQ ID NO: 4215 - protein, 160 aa, Unknown; identical to SEQ ID NO: 4076
  Description of Unknown: uncultivated organism
  MG4-162 HNH domain

SEQ ID NO: 4216 - protein, 160 aa, Unknown; identical to SEQ ID NO: 4182
  Description of Unknown: uncultivated organism with predicted taxonomy: Acidobacteriales bacterium 59-55
  MG4-163 HNH domain

SEQ ID NO: 4217 - protein, 160 aa, Unknown; identical to SEQ ID NO: 4179
  Description of Unknown: uncultivated organism
  MG4-164 HNH domain

SEQ ID NO: 4218 - protein, 157 aa, Unknown; identical to SEQ ID NO: 4170
  Description of Unknown: uncultivated organism
  MG4-165 HNH domain

SEQ ID NO: 4219 - protein, 157 aa, Unknown; identical to SEQ ID NO: 4207
  Description of Unknown: uncultivated organism with predicted taxonomy: Candidatus Sulfotelmatomonas gaucii
  MG4-166 HNH domain

SEQ ID NO: 4220 - protein, 165 aa, Unknown; identical to SEQ ID NO: 4185
  Description of Unknown: uncultivated organism with predicted taxonomy: Acidobacteriales bacterium 59-55
  MG4-167 HNH domain

SEQ ID NO: 4221 - protein, 160 aa, Unknown; identical to SEQ ID NO: 4179
  Description of Unknown: uncultivated organism
  MG4-168 HNH domain

SEQ ID NO: 4222 - protein, 157 aa, Unknown; identical to SEQ ID NO: 4170
  Description of Unknown: uncultivated organism
  MG4-169 HNH domain

SEQ ID NO: 4223 - protein, 160 aa, Unknown; identical to SEQ ID NO: 4179
  Description of Unknown: uncultivated organism
  MG4-170 HNH domain

SEQ ID NO: 4224 - protein, 157 aa, Unknown; identical to SEQ ID NO: 4170
  Description of Unknown: uncultivated organism
  MG4-171 HNH domain

SEQ ID NO: 4225 - protein, 157 aa, Unknown; identical to SEQ ID NO: 4170
  Description of Unknown: uncultivated organism
  MG4-172 HNH domain

SEQ ID NO: 4226 - protein, 167 aa, Unknown
  Description of Unknown: uncultivated organism with predicted taxonomy: Ignavibacteriales bacterium CG_4_9_14_3_um_filter_30_11
  MG4-173 HNH domain
DLKKSKKERQKQTEINRDREKLRQEATGELRKHDVVRFANPRNSDIEKYLLATEARWQCPYTSKKYGVTDVFGDHPQVDVEHIIPRSRSLDDSYLNKTLAYRSANMEKGNRTPREWLFESDQEQYDRMIGVVSGFDPRFEVGKKLRRFSMELSDPDSLLKEFTERQL

SEQ ID NO: 4227 - protein, 160 aa, Unknown; identical to SEQ ID NO: 4191
  Description of Unknown: uncultivated organism with predicted taxonomy: uncultured bacterium
  MG4-174 HNH domain

SEQ ID NO: 4228 - protein, 160 aa, Unknown; identical to SEQ ID NO: 4179
  Description of Unknown: uncultivated organism
  MG4-175 HNH domain

SEQ ID NO: 4229 - protein, 157 aa, Unknown; identical to SEQ ID NO: 4170
  Description of Unknown: uncultivated organism with predicted taxonomy: Acidobacteriales bacterium 59-55
  MG4-176 HNH domain

SEQ ID NO: 4230 - protein, 168 aa, Unknown; identical to SEQ ID NO: 4193
  Description of Unknown: uncultivated organism
  MG4-177 HNH domain

SEQ ID NO: 4231 - protein, 157 aa, Unknown; identical to SEQ ID NO: 4170
  Description of Unknown: uncultivated organism with predicted taxonomy: Acidobacteriales bacterium 59-55
  MG4-178 HNH domain

SEQ ID NO: 4232 - protein, 160 aa, Unknown; identical to SEQ ID NO: 4182
  Description of Unknown: uncultivated organism with predicted taxonomy: Acidobacteria
  MG4-179 HNH domain

SEQ ID NO: 4233 - protein, 157 aa, Unknown; identical to SEQ ID NO: 4175
  Description of Unknown: uncultivated organism
  MG4-180 HNH domain

SEQ ID NO: 4234 - protein, 160 aa, Unknown; identical to SEQ ID NO: 4179
  Description of Unknown: uncultivated organism
  MG4-181 HNH domain

SEQ ID NO: 4235 - protein, 157 aa, Unknown; identical to SEQ ID NO: 4170
  Description of Unknown: uncultivated organism
  MG4-182 HNH domain

SEQ ID NO: 4236 - protein, 160 aa, Unknown; identical to SEQ ID NO: 4191
  Description of Unknown: uncultivated organism
  MG4-183 HNH domain

SEQ ID NO: 4237 - protein, 157 aa, Unknown; identical to SEQ ID NO: 4175
  Description of Unknown: uncultivated organism
  MG4-184 HNH domain

SEQ ID NO: 4238 - protein, 157 aa, Unknown; identical to SEQ ID NO: 4170
  Description of Unknown: uncultivated organism
  MG4-185 HNH domain

SEQ ID NO: 4239 - protein, 160 aa, Unknown; identical to SEQ ID NO: 4179
  Description of Unknown: uncultivated organism
  MG4-186 HNH domain

SEQ ID NO: 4240 - protein, 160 aa, Unknown; identical to SEQ ID NO: 4182
  Description of Unknown: uncultivated organism with predicted taxonomy: Polaribacter sp. ALD11
  MG4-187 HNH domain

SEQ ID NO: 4241 - protein, 157 aa, Unknown; identical to SEQ ID NO: 4170
  Description of Unknown: uncultivated organism with predicted taxonomy: Acidobacteriales bacterium 59-55
  MG4-188 HNH domain

SEQ ID NO: 4242 - protein, 160 aa, Unknown; identical to SEQ ID NO: 4182
  Description of Unknown: uncultivated organism with predicted taxonomy: Polaribacter sp. ALD11
  MG4-189 HNH domain

SEQ ID NO: 4243 - protein, 157 aa, Unknown; identical to SEQ ID NO: 4175
  Description of Unknown: uncultivated organism
  MG4-190 HNH domain

SEQ ID NO: 4244 - protein, 160 aa, Unknown; identical to SEQ ID NO: 4179
  Description of Unknown: uncultivated organism
  MG4-191 HNH domain

SEQ ID NO: 4245 - protein, 157 aa, Unknown; identical to SEQ ID NO: 4170
  Description of Unknown: uncultivated organism
  MG4-192 HNH domain

SEQ ID NO: 4246 - protein, 157 aa, Unknown; identical to SEQ ID NO: 4170
  Description of Unknown: uncultivated organism with predicted taxonomy: Acidobacteriales bacterium 59-55
  MG4-193 HNH domain

SEQ ID NO: 4247 - protein, 160 aa, Unknown; identical to SEQ ID NO: 4179
  Description of Unknown: uncultivated organism
  MG4-194 HNH domain

SEQ ID NO: 4248 - protein, 157 aa, Unknown; identical to SEQ ID NO: 4170
  Description of Unknown: uncultivated organism
  MG4-195 HNH domain

SEQ ID NO: 4249 - protein, 160 aa, Unknown; identical to SEQ ID NO: 4182
  Description of Unknown: uncultivated organism with predicted taxonomy: Acidobacteriales bacterium 59-55
  MG4-196 HNH domain

SEQ ID NO: 4250 - protein, 157 aa, Unknown; identical to SEQ ID NO: 4170
  Description of Unknown: uncultivated organism
  MG4-197 HNH domain

SEQ ID NO: 4251 - protein, 163 aa, Unknown; identical to SEQ ID NO: 4209
  Description of Unknown: uncultivated organism
  MG4-198 HNH domain

SEQ ID NO: 4252 - protein, 160 aa, Unknown; identical to SEQ ID NO: 4179
  Description of Unknown: uncultivated organism
  MG4-199 HNH domain

SEQ ID NO: 4253 - protein, 160 aa, Unknown; identical to SEQ ID NO: 4179
  Description of Unknown: uncultivated organism
  MG4-200 HNH domain

SEQ ID NO: 4254 - protein, 160 aa, Unknown; identical to SEQ ID NO: 4182
  Description of Unknown: uncultivated organism with predicted taxonomy: Acidobacteriales bacterium 59-55
  MG4-201 HNH domain

SEQ ID NO: 4255 - protein, 157 aa, Unknown; identical to SEQ ID NO: 4170
  Description of Unknown: uncultivated organism with predicted taxonomy: Acidobacteriales bacterium 59-55
  MG4-202 HNH domain

SEQ ID NO: 4256 - protein, 157 aa, Unknown; identical to SEQ ID NO: 4170
  Description of Unknown: uncultivated organism with predicted taxonomy: Acidobacteriales bacterium 59-55
  MG4-203 HNH domain

SEQ ID NO: 4257 - protein, 157 aa, Unknown; identical to SEQ ID NO: 4170
  Description of Unknown: uncultivated organism with predicted taxonomy: Acidobacteriales bacterium 59-55
  MG4-204 HNH domain

SEQ ID NO: 4258 - protein, 167 aa, Unknown
  Description of Unknown: uncultivated organism with predicted taxonomy: Acidobacteria
  MG4-205 HNH domain
DLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQL

SEQ ID NO: 4259 - protein, 157 aa, Unknown; identical to SEQ ID NO: 4170
  Description of Unknown: uncultivated organism
  MG4-206 HNH domain

SEQ ID NO: 4260 - protein, 167 aa, Unknown; identical to SEQ ID NO: 4258
  Description of Unknown: uncultivated organism
  MG4-207 HNH domain

SEQ ID NO: 4261 - protein, 157 aa, Unknown; identical to SEQ ID NO: 4175
  Description of Unknown: uncultivated organism
  MG4-208 HNH domain

SEQ ID NO: 4262 - protein, 160 aa, Unknown; identical to SEQ ID NO: 4179
  Description of Unknown: uncultivated organism
  MG4-209 HNH domain

SEQ ID NO: 4263 - protein, 168 aa, Unknown; identical to SEQ ID NO: 4193
  Description of Unknown: uncultivated organism with predicted taxonomy: candidate division Kazan bacterium
  MG4-210 HNH domain

SEQ ID NO: 4264 - protein, 160 aa, Unknown; identical to SEQ ID NO: 4182
  Description of Unknown: uncultivated organism with predicted taxonomy: Acidobacteriales bacterium 59-55
  MG4-211 HNH domain

SEQ ID NO: 4265 - protein, 157 aa, Unknown; identical to SEQ ID NO: 4175
  Description of Unknown: uncultivated organism
  MG4-212 HNH domain

SEQ ID NO: 4266 - protein, 160 aa, Unknown; identical to SEQ ID NO: 4182
  Description of Unknown: uncultivated organism with predicted taxonomy: Polaribacter sp. ALD11
  MG4-213 HNH domain

SEQ ID NO: 4267 - protein, 160 aa, Unknown; identical to SEQ ID NO: 4179
  Description of Unknown: uncultivated organism
  MG4-214 HNH domain

SEQ ID NO: 4268 - protein, 168 aa, Unknown; identical to SEQ ID NO: 4193
  Description of Unknown: uncultivated organism
  MG4-215 HNH domain

SEQ ID NO: 4269 - protein, 157 aa, Unknown; identical to SEQ ID NO: 4170
  Description of Unknown: uncultivated organism
  MG4-216 HNH domain

SEQ ID NO: 4270 - protein, 162 aa, Unknown
  Description of Unknown: uncultivated organism with predicted taxonomy: candidate division Zixibacteria bacterium CG_4_9_14_3_um_filter_46_8
  MG4-217 HNH domain
DLKQSKDHRLRATKNARDNEESRKAAIRKILAETPVRSPGPDDILRAQLYEECNHECPYTGRKIAFAALFGDSPQFDIEHIIPFSRCLDDSFANKTLCYHEVNRHVKGNRTPLEAFGSTPEWERIVQSVRLFSGKAAEGKLRRFLMTEEEILKLQDFANSQL

SEQ ID NO: 4271 - protein, 161 aa, Unknown
  Description of Unknown: uncultivated organism with predicted taxonomy: Planctomicrobium piriforme
  MG4-218 HNH domain
DMRRSKKQRQESWLRMRQNERDRKRAAQKILAEMNNDSPSRQDKEKVLLAEECNWTCPYTGKCISMQSLLGPTPQFDIEHIIPFSRSLDDSFTNKTLCDIAENRDHKRNRTPFEAYAAEPDKWNAILGRVGRFRSNAREEKVRRFRQEEIEGIEDFAARQL

SEQ ID NO: 4272 - protein, 157 aa, Unknown; identical to SEQ ID NO: 4207
  Description of Unknown: uncultivated organism with predicted taxonomy: Candidatus Sulfotelmatomonas gaucii
  MG4-219 HNH domain

SEQ ID NO: 4273 - protein, 162 aa, Unknown
  Description of Unknown: uncultivated organism with predicted taxonomy: Proteobacteria
  MG4-220 HNH domain
DLRKSRKEREANWKKNRDIEKSRKIMAERITAEAGITDPSREDIRKALLAKECGWVCPYTGRAISMRALVGPDAQFDIEHIIPFSQSLDNSFFNVTLCYHEENRNRKRNQTPYGAYGNEPEKFQEILDRVRRFDSDLADEKLKRFQLTDTADILKGFVDRQL

SEQ ID NO: 4274 - protein, 160 aa, Unknown; identical to SEQ ID NO: 4182
  Description of Unknown: uncultivated organism with predicted taxonomy: Acidobacteriales bacterium 59-55
  MG4-221 HNH domain

SEQ ID NO: 4275 - protein, 157 aa, Unknown; identical to SEQ ID NO: 4170
  Description of Unknown: uncultivated organism
  MG4-222 HNH domain

SEQ ID NO: 4276 - protein, 160 aa, Unknown; identical to SEQ ID NO: 4179
  Description of Unknown: uncultivated organism
  MG4-223 HNH domain

SEQ ID NO: 4277 - protein, 157 aa, Unknown; identical to SEQ ID NO: 4175
  Description of Unknown: uncultivated organism
  MG4-224 HNH domain

SEQ ID NO: 4278 - protein, 168 aa, Unknown; identical to SEQ ID NO: 4193
  Description of Unknown: uncultivated organism
  MG4-225 HNH domain

SEQ ID NO: 4279 - protein, 160 aa, Unknown; identical to SEQ ID NO: 4182
  Description of Unknown: uncultivated organism with predicted taxonomy: Polaribacter sp. ALD11
  MG4-226 HNH domain

SEQ ID NO: 4280 - protein, 160 aa, Unknown; identical to SEQ ID NO: 4179
  Description of Unknown: uncultivated organism
  MG4-227 HNH domain

SEQ ID NO: 4281 - protein, 164 aa, Unknown
  Description of Unknown: uncultivated organism
  MG4-247 HNH domain
DLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQL

SEQ ID NO: 4282 - protein, 164 aa, Unknown; identical to SEQ ID NO: 4281
  Description of Unknown: uncultivated organism with predicted taxonomy: Planctomycetes
  MG4-248 HNH domain

SEQ ID NO: 4283 - protein, 163 aa, Unknown
  Description of Unknown: uncultivated organism with predicted taxonomy: Fuerstia marisgermanicae
  MG4-249 HNH domain
ELKKPKKRRELISKRNDENRSERETARREITEETGDPYPGKTDIRKVLLRRECGDQCVYCGEQFSGSNFFSDDAPIEIDHIIPRSLHWDDSFLNLALCHAKCNREKGDNTPAQVFSDEVIEQIRDRIRRFSGNEKTKRERFRRFTLAGAELSAYLEEFSRRQL

SEQ ID NO: 4284 - protein, 163 aa, Unknown
  Description of Unknown: uncultivated organism
  MG4-250 HNH domain
EMKKPKWRRKQISKRNRENETGRKQAKEEIKRETQNPYPSPYDIRKLILYKECRGQCVYCGAQISRSNLFGDNSDSEVDHIIPFSRLQEDSFTHVVLCHARCNAEKGNRTPSEAFTGEEHERILDRVSRFDNDEATRKAKLRHFTLAGEELANYLNDFSSRQL

SEQ ID NO: 4285 - protein, 156 aa, Unknown
  Description of Unknown: uncultivated organism
  MG4-251 HNH domain
DLKSSNKERERRTFEIRKREKARAEIAERIAREAQIEKPSRNDILKVMLADECNFTCPYTGKNFSMKELLYGKDIQIEHIIPYSRSFDDSFRNKTLCFSSANAKKNNRTPFEAFSGAEYEEILQRVGKFKWPFAEDKKDLFKCEKVDSEEFLARNL

SEQ ID NO: 4286 - protein, 156 aa, Unknown
  Description of Unknown: uncultivated organism with predicted taxonomy: Bdellovibrio exovorus
  MG4-252 HNH domain
DLKNTNKEKERITKQNREKEKERVKIIQQIIKEVGIASPTRNDILKVQLAEECGFECPYTGKHFSMAQLFDGNTIQIEHIIPFSRSFDDSYRNKTLCMATENGRKNNRTPYEAYAKEEYKAILTRVSHFKGPFRESKLQIFETKEFSPDDFLQRNL

SEQ ID NO: 4287 - protein, 156 aa, Unknown; identical to SEQ ID NO: 4285
  Description of Unknown: uncultivated organism
  MG4-253 HNH domain

SEQ ID NO: 4288 - protein, 156 aa, Unknown
  Description of Unknown: uncultivated organism
  MG4-254 HNH domain
DLKSSAKERERRMWEMRQREKERTAIAGKIAEEAGIENPSRNDILKVMLAEECGYECPYTGKHFSMRDLLHGKDIHIEHIIPYSRSFDDSYRNKTLCLASANAAKNNRTPFEAFSGKEYQDILQRVARFRGPFAEAKLALFKLEKVEPEEFLERNL

SEQ ID NO: 4289 - protein, 156 aa, Unknown; identical to SEQ ID NO: 4285
  Description of Unknown: uncultivated organism
  MG4-255 HNH domain

SEQ ID NO: 4290 - protein, 156 aa, Unknown; identical to SEQ ID NO: 4285
  Description of Unknown: uncultivated organism
  MG4-256 HNH domain

SEQ ID NO: 4291 - protein, 161 aa, Unknown
  Description of Unknown: uncultivated organism with predicted taxonomy: Planctomycetes
  MG4-257 HNH domain
DIKRNREERQNINKKISERTKEREAARTRLQEDFNLADPKSSDIEKYLLWQESGPKCPYCGNPIAGEVLFSGATHIDHIIPRKVSLDNSFVNKVLCCSKCNNDKSDRTPHEAFNGDTQRWEKIAERVGAFRSEYRREKLRRVLMTKKEAQEFYTGFTDSQL

SEQ ID NO: 4292 - protein, 160 aa, Unknown
  Description of Unknown: uncultivated organism
  MG4-258 HNH domain
DLKRNAKQREMNWRRGRDRETVRTAAVKRILDEAHRPQPWKQDVDRVLLLEECRDLCVYCGQAISFQRLFDGDIDIDHILPRNRFPDDSFANRCLAHRACNQLKLGRTPYEAFGSDEELWPNIIARVKTWDNPDKLERFNLRDDGEFDPEREDSFAARRL

SEQ ID NO: 4293 - protein, 157 aa, Unknown
  Description of Unknown: uncultivated organism with predicted taxonomy: Acidobacteria
  MG4-259 HNH domain
ELRKSRKERENVTKRNRSRERERQQAKARILQECGLQNPSRADIEKALLFEECGGVCPYTGRTIEFSSLFRDSQFDVEHIIPLSRYPDDSFLNKTLCYHEENRSVKRGRTPWEAYGPDSERWDAILSRVQGFNNPAKLTRFKLRTEEELGEFTQRQM

SEQ ID NO: 4294 - protein, 161 aa, Unknown
  Description of Unknown: uncultivated organism with predicted taxonomy: Planctomycetes bacterium
  MG4-260 HNH domain
DLKKPRHERAEAITKNRNREKERVAAKTKLLQELGPGFEHPSRADVEKALLHEECGGVCPYTGRHIEFASLFGENPQFDVEHIIPFSRIPDDSFQNKTLCYHEENRLVKRNMTPFEVYKDPAQYEAILNRVRTWKKLNPGKQRRFELRTLEELEGFSARQL

SEQ ID NO: 4295 - protein, 157 aa, Unknown
  Description of Unknown: uncultivated organism
  MG4-261 HNH domain
DLKASNKEREQITKRNQQRERERNAIAERIIKETGLEKISRKDILKVMLADECDFTCPYSGKRFSMTELLNGGLVEVEHIIPFSRSFDDSFANKTLCVRELNAKKNNRTPFEAFGGSPQYSEMLTRVKYFKGHFAEHKLNLFKLAEIESSGFLERNL

SEQ ID NO: 4296 - protein, 154 aa, Unknown
  Description of Unknown: uncultivated organism with predicted taxonomy: Planctomycetes
  MG6-7 HNH domain
DVKGNAKEREELRIKMNRNEKENERARHELIHNMGITRPTRDDILKYKLWQECGRECPYTGRPISQQALFGEHPEFQIEHIIPYSRCLDDSFMNKTLCYVDENRRKGDQTPYEFYKNSDQYEHMLQRIRKLPYPKRQKFTQKEVSLDEFIKRQL

SEQ ID NO: 4297 - protein, 155 aa, Unknown
  Description of Unknown: uncultivated organism with predicted taxonomy: Planctomycetes bacterium
  MG6-8 HNH domain
DVKGSVKERDEIRVKQWKNEQENKRAEEELKLMGIRNPSFNDRLKYKLWEECGKECPYTGKPISQHQLFGEHPDIQIEHILPYSRTLDDSYMNKTLCYVNENRLKGNETPYEYYAENRVEQWEEILQRIKVLPYAKRRRFWQKEVVLDNFIQRQL

SEQ ID NO: 4298 - protein, 155 aa, Unknown
  Description of Unknown: uncultivated organism
  MG6-9 HNH domain
DVKGSLKEREEIQWKMRENEKRNEAARTRLIQDMDILNPSRDDVIKYKLWEECGKRCPYTGKVISLTDLFGSNPVFQVEHILPYSRSLDDSYMNKTLCCVNENRIKGNKTPYEFYSGDEEKYEQVKQQIKVLPWPKRRRFLQKEIKLDECIQREM

SEQ ID NO: 4299 - protein, 156 aa, Unknown
  Description of Unknown: uncultivated organism with predicted taxonomy: Planctomycetes bacterium
  MG6-10 HNH domain
DLKGSLRERKEIHFKQKENERENKRVRERLKNDFNHVSLNRDNIIKYKLWEECNGLCPYTGKKIPQYALFGENPEFQIEHILPYSRSLDDSYMNKTLCEVHENISVKGNQTPYEAYHHDEEKYEQIKQRIKVLPWPKRRKFLQKEIELDEAITREL

SEQ ID NO: 4300 - protein, 155 aa, Unknown; identical to SEQ ID NO: 4297
  Description of Unknown: uncultivated organism with predicted taxonomy: Planctomycetes bacterium
  MG6-11 HNH domain

SEQ ID NO: 4301 - protein, 155 aa, Unknown; identical to SEQ ID NO: 4298
  Description of Unknown: uncultivated organism
  MG6-12 HNH domain

SEQ ID NO: 4302 - protein, 156 aa, Unknown; identical to SEQ ID NO: 4299
  Description of Unknown: uncultivated organism with predicted taxonomy: Planctomycetes bacterium
  MG6-13 HNH domain

SEQ ID NO: 4303 - protein, 165 aa, Unknown
  Description of Unknown: uncultivated organism
  MG6-20 HNH domain
EIKGSLRQRAEIRDQQEASRKDREEIRTMLRDPIEFGKDNPSNDDILAYRLWEQQGHLSPYSGKTICQTDLRRFLNGEGVLEIDHILPYSKSWDNSQSNKCLCFSDENKNKKDFTPRQWLGDGTDAYTSMLQYVAGMKTTGMPFSKRRKFSQLEVDPEDCAKRQL

SEQ ID NO: 4304 - protein, 175 aa, Unknown
  Description of Unknown: uncultivated organism with predicted taxonomy: Arcicella aurantiaca
  MG7-2 HNH domain
ELKQNIKQRERTERNNNKRQKARKDVVKEILKTFPDMKEKDVTNRMIQKYELFQETNGICVYTGTEMKLGAVLSGQGFDIEHIIPKSRRFDDSFMNKTLADSSTNRDKNDLTAYDFMRKKGMTSFEKFTEIIHKLHKDKKISDTKLDNLLTTLNPVWIAEQEAKALSTDFINRQL

SEQ ID NO: 4305 - protein, 175 aa, Unknown
  Description of Unknown: uncultivated organism with predicted taxonomy: Flavobacteriales
  MG7-5 HNH domain
ELKQNIKQRERTESNNNKRQKARKDVVKEILKTFPDMKEKEVTQRMIQKYELFQETNGICVYTGTEMKLGAVLAGQGYDIEHIIPKSRRFDDSFMNKTLADSSTNRDKNDLTAYDFMRNKGMTAFEKFTEIIHTLHKNKKISDAKLDNLLTTLNPVWIAEKEAKELSTDFISRQL

SEQ ID NO: 4306 - protein, 175 aa, Unknown
  Description of Unknown: uncultivated organism with predicted taxonomy: Arcicella aurantiaca
  MG7-6 HNH domain
ELKQNIKQRERTESNNNKRQKARKDVVKEILKTFPDMKEKEVTQRMIQKYELFQETNGICIYTGTEMKLGAVLSGQGYDIEHIIPKSRRFDDSFMNKTLADSSTNRDKNDLTAYDFMRNKGTTAFEKFTEIIHKLHKDKKISDTKLDNLLTTLNPVWIAEQEAKALSTDFISRQL

SEQ ID NO: 4307 - protein, 167 aa, Unknown
  Description of Unknown: uncultivated organism
  MG7-9 HNH domain
ELKQSAQERKKTHELNQKRRRENERIKKDIADHLAIPPEKVTRAQIEKYRFYKEIDGISLYTGKRFSLADVLNGDTVDVEHIIPRTLRFDDSYHNKTLCERNINQEKGNMTACDYMRSRGAQEYEAYLERVKAFYEKNGREVRLKYKNLTTTQEDLLKDNEFLQRQL

SEQ ID NO: 4308 - protein, 169 aa, Unknown
  Description of Unknown: uncultivated organism with predicted taxonomy: Bacteroidetes
  MG7-10 HNH domain
ELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDGEFLQRQL

SEQ ID NO: 4309 - protein, 163 aa, Unknown
  Description of Unknown: uncultivated organism with predicted taxonomy: Bacteroidetes
  MG7-11 HNH domain
ELKQNAEERNKTFSRNKKEDAKHKDIIHRLMTECNFKKVSRRDIERYKLWEEFGYVSPYEPSKPISLSELFSGAYEVEHIIPKSRLFDDSFANKTICPRPINAAKDNQTAFDYMSGLGQQKLDEFTDFIQKHKTKKDGISQTKAKYLLCKGSEIPQDFINRQM

SEQ ID NO: 4310 - protein, 169 aa, Unknown
  Description of Unknown: uncultivated organism with predicted taxonomy: Bacteroidetes
  MG7-12 HNH domain
ELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDEEFLQRQL

SEQ ID NO: 4311 - protein, 153 aa, Unknown
  Description of Unknown: uncultivated organism with predicted taxonomy: Deltaproteobacteria bacterium
  MG7-13 HNH domain
ELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANREKGNRTAYEYMEQKGELEKFREHVMNTNYPFPKKKRLLSPEVPEDFIQRQL

SEQ ID NO: 4312 - protein, 153 aa, Unknown
  Description of Unknown: uncultivated organism with predicted taxonomy: Deltaproteobacteria bacterium
  MG7-14 HNH domain
ELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANKEKGNRTAYEYMEQKGELEKFREHVMNTNYPFPKKKRLLSPEVPEDFIQRQL

SEQ ID NO: 4313 - protein, 163 aa, Unknown
  Description of Unknown: uncultivated organism with predicted taxonomy: Collinsella
  MG14-1 HNH domain
ELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4314 - protein, 172 aa, Unknown
  Description of Unknown: uncultivated organism
  MG14-3 HNH domain
ELKHSAHEKRLINASKNKNEKVNAKARQDLIDYYHLPSDAHIKTGDFRKVKLYNEQGGKDPYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQL

SEQ ID NO: 4315 - protein, 165 aa, Unknown
  Description of Unknown: uncultivated organism with predicted taxonomy: Coriobacteriales
  MG14-4 HNH domain
ELRLPQCAKDDIAKANKKNEKNRERIAGQIAELRGCSVEEVTGKQIEKYRLWEEQECFDLYTGDSIDVMRLIQDDSYTQIDHILPFSRTGENSKNNKVLVLAKSNQDKREQTPYEWMHSGKPSAPSWSDFERRVQENQKLSRRKKNFLLEKDLDSKEGEFLARSF

SEQ ID NO: 4316 - protein, 165 aa, Unknown; identical to SEQ ID NO: 4315
  Description of Unknown: uncultivated organism with predicted taxonomy: Actinobacteria
  MG14-5 HNH domain

SEQ ID NO: 4317 - protein, 172 aa, Unknown
  Description of Unknown: uncultivated organism with predicted taxonomy: Collinsella
  MG14-6 HNH domain
ELKHSAHEKRLINASKNKNEKINAKARQDLIDYYHLPSDAHIKTGDFRKVKLYNEQGGKDAYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQL

SEQ ID NO: 4318 - protein, 163 aa, Unknown
  Description of Unknown: uncultivated organism with predicted taxonomy: Collinsella
  MG14-7 HNH domain
ELRLPQRAKDEIAKANKKNEKNRERIARQIAELRGCTADEVTGKQIEKYRLWEEQECFDLYTGAKIEVDRLISDGTYTQIDHILPFSRTGENSRNNKVLVLAKSNQDKREQTPYEWMSHDGAPSWDAFERRVQENQKLSRRKKNFLLEKDLGTKEGEFLARSF

SEQ ID NO: 4319 - protein, 165 aa, Unknown
  Description of Unknown: uncultivated organism with predicted taxonomy: Olsenella
  MG14-8 HNH domain
ELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMSSGEAGAPSWDSYRARVMAQVKNPRKRANYLNTDLGPETQAKFLARNL

SEQ ID NO: 4320 - protein, 165 aa, Unknown
  Description of Unknown: uncultivated organism with predicted taxonomy: Olsenella sp. KH3B4
  MG14-9 HNH domain
ELKMSNKEKSLVDKRNRENAAANKKWAEKAAGILGCTPEEVSGRVIRKLILREEQGEKDLYTGQPIDLERLVRDDRYCEIDHILPYSRTCDDSRTNKVLVLSKSNQDKRERTPYEWMTSGETGAPSWDEYHARIMATVKNPRKRANYLNTDLGPETQAKFLARNL

SEQ ID NO: 4321 - protein, 163 aa, Unknown
  Description of Unknown: uncultivated organism with predicted taxonomy: Collinsella
  MG14-10 HNH domain
ELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSF

SEQ ID NO: 4322 - protein, 172 aa, Unknown
  Description of Unknown: uncultivated organism with predicted taxonomy: Collinsella sp. AF20-14LB
  MG14-11 HNH domain
DLKHTKREKKLITSGNIYNRKVNEKAKDDIVEFLGLANADRVRGRDLEKVRLYNEQGGKDPYTGQGIDFGRMLTEKSYVEVDHVLPFSRSCDNSKTNKVLVLTKSNRDKANRTPYEWMTSGEPTAPNWDEFCIRMDVWASGKEPKHYYSSKLAKLKEDNFTNNIDSFISRNL

SEQ ID NO: 4323 - protein, 163 aa, Unknown
  Description of Unknown: uncultivated organism with predicted taxonomy: Collinsella
  MG14-12 HNH domain
ELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSF

SEQ ID NO: 4324 - protein, 163 aa, Unknown; identical to SEQ ID NO: 4323
  Description of Unknown: uncultivated organism with predicted taxonomy: Collinsella
  MG14-13 HNH domain

SEQ ID NO: 4325 - protein, 165 aa, Unknown
  Description of Unknown: uncultivated organism with predicted taxonomy: Olsenella
  MG14-14 HNH domain
ELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNL

SEQ ID NO: 4326 - protein, 163 aa, Unknown; identical to SEQ ID NO: 4323
  Description of Unknown: uncultivated organism with predicted taxonomy: Coriobacteriales
  MG14-15 HNH domain

SEQ ID NO: 4327 - protein, 172 aa, Unknown
  Description of Unknown: uncultivated organism with predicted taxonomy: Eggerthellales
  MG14-16 HNH domain
ELKRSKHEREVVAESNRARRELNEQAKRDIVEFLGLPDDHHVRGRDLDMVKLYREQGGKDPYTGAGIDFRRMLEEHGYAEIDHILPISRTCDDSQANKVLCLTKSNRDKSNRSPYEWMTSGEAAAPDWDEFCGRMDRWAKMCEPRRYVRKKLANLTCENLAEHAEDFIKRNL

SEQ ID NO: 4328 - protein, 163 aa, Unknown; identical to SEQ ID NO: 4323
  Description of Unknown: uncultivated organism with predicted taxonomy: Collinsella
  MG14-17 HNH domain

SEQ ID NO: 4329 - protein, 165 aa, Unknown
  Description of Unknown: uncultivated organism with predicted taxonomy: Olsenella
  MG14-18 HNH domain
DLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANYLNTDLGPETQAKFLARNL

SEQ ID NO: 4330 - protein, 163 aa, Unknown
  Description of Unknown: uncultivated organism with predicted taxonomy: Coriobacteriales
  MG14-19 HNH domain
ELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKNLDAKEGEFLARSF

SEQ ID NO: 4331 - protein, 163 aa, Unknown; identical to SEQ ID NO: 4323
  Description of Unknown: uncultivated organism with predicted taxonomy: Coriobacteriales
  MG14-20 HNH domain

SEQ ID NO: 4332 - protein, 165 aa, Unknown; identical to SEQ ID NO: 4325
  Description of Unknown: uncultivated organism with predicted taxonomy: Olsenella sp. KH3B4
  MG14-21 HNH domain

SEQ ID NO: 4333 - protein, 163 aa, Unknown; identical to SEQ ID NO: 4323
  Description of Unknown: uncultivated organism with predicted taxonomy: Collinsella
  MG14-22 HNH domain

SEQ ID NO: 4334 - protein, 163 aa, Unknown; identical to SEQ ID NO: 4323
  Description of Unknown: uncultivated organism with predicted taxonomy: Collinsella
  MG14-23 HNH domain

SEQ ID NO: 4335 - protein, 163 aa, Unknown
  Description of Unknown: uncultivated organism with predicted taxonomy: Collinsella
  MG14-24 HNH domain
ELRLPQRAKDDIAKAHKKNEKNRERIAGQIAELRGCNPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSF

SEQ ID NO: 4336 - protein, 165 aa, Unknown
  Description of Unknown: uncultivated organism with predicted taxonomy: Olsenella
  MG14-25 HNH domain
ELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNL

SEQ ID NO: 4337 - protein, 163 aa, Unknown; identical to SEQ ID NO: 4323
  Description of Unknown: uncultivated organism with predicted taxonomy: Coriobacteriia
  MG14-26 HNH domain

SEQ ID NO: 4338 - protein, 163 aa, Unknown; identical to SEQ ID NO: 4323
  Description of Unknown: uncultivated organism with predicted taxonomy: Collinsella
  MG14-27 HNH domain

SEQ ID NO: 4339 - protein, 172 aa, Unknown
  Description of Unknown: uncultivated organism with predicted taxonomy: Collinsella
  MG14-28 HNH domain
ELKHTKHEKKLVDDGNKYNKREKEKAADDIVEYLGLSSADQVRGRDIDKVRLYNEQGGKDLYTGQGIDFGRMLTEKGYVEIDHILPYSRSCDNSRTNKVLVLTKSNRDKANRTPYEWMTSGEPTAPNWDEFCIRMDVWASGKEPKHYYSSKLAKLKEDNFTNNIDSFISRNL

SEQ ID NO: 4340 - protein, 163 aa, Unknown; identical to SEQ ID NO: 4323
  Description of Unknown: uncultivated organism with predicted taxonomy: Coriobacteriales
  MG14-29 HNH domain

SEQ ID NO: 4341 - protein, 163 aa, Unknown; identical to SEQ ID NO: 4330
  Description of Unknown: uncultivated organism with predicted taxonomy: Collinsella
  MG14-30 HNH domain

SEQ ID NO: 4342 - protein, 161 aa, Unknown
  Description of Unknown: uncultivated organism with predicted taxonomy: Coriobacteriia bacterium
  MG14-31 HNH domain
ELKQSAKEKDAILKSNNKTNKSREVLRKKLAEELSCDEDAIPFKLLEKIELWNQQDGRDLYVDEPIQYERLISDDSYCEIDHILPYSRTCDDSRMNKILVLQKSNQNKRESTPFEWMSATGDWDNFKLRILRLAHYPQKKKQRLLNTDLAEKQPEFIARNL

SEQ ID NO: 4343 - protein, 165 aa, Unknown
  Description of Unknown: uncultivated organism with predicted taxonomy: Olsenella sp. KH3B4
  MG14-32 HNH domain
DLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNL

SEQ ID NO: 4344 - protein, 163 aa, Unknown; identical to SEQ ID NO: 4323
  Description of Unknown: uncultivated organism with predicted taxonomy: Collinsella
  MG14-33 HNH domain

SEQ ID NO: 4345 - protein, 165 aa, Unknown
  Description of Unknown: uncultivated organism with predicted taxonomy: Olsenella
  MG14-34 HNH domain
DLKMSNKEKKQVEKRNRENAASNKKWATTAAGILGCTPEEVPGRIIRKLILREEQGEKDLYTGDSIDLEHLVRDDRYCEIGHILPYSRTCDDSRANKVLVLSKSNQDKRERTPYEWMTSGETSAPSWDSYRARVMAQVKNPRKRANYLNTDLGPETQAKFLARNL

SEQ ID NO: 4346 - protein, 167 aa, Unknown
  Description of Unknown: uncultivated organism with predicted taxonomy: Olsenella sp. KH3B4
  MG14-35 HNH domain
DLKMSKREKDAVSKRQRQNEATNKKWAKTAAGILGCEPEEVPGKVIRKLAMREEQGEKDAYTNAPIDLERLVREDHYCEIDHILPYSRTSEDSRANKVLVLSKSNQDKRERTPYEWMTQDVGKPGVPNWDEYHARVVATVKHPRKRANLLNTDLGPETEAKFLARNL

SEQ ID NO: 4347 - protein, 163 aa, Unknown
  Description of Unknown: uncultivated organism with predicted taxonomy: Coriobacteriales
  MG14-36 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4348 - protein, 172 aa, Unknown
  Description of Unknown: uncultivated organism with predicted taxonomy: Coprococcus comes
  MG14-37 HNH domain
DLKRSKHEKAIIAATNKANKDSNEQAKKDLVAFYGLPNDAHVSSADFEKMWLYREQFGQDPYTGKGINLERMLNERDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNL

SEQ ID NO: 4349 - protein, 163 aa, Unknown
  Description of Unknown: uncultivated organism with predicted taxonomy: Coriobacteriia bacterium
  MG14-38 HNH domain
ELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSF

SEQ ID NO: 4350 - protein, 163 aa, Unknown; identical to SEQ ID NO: 4347
  Description of Unknown: uncultivated organism with predicted taxonomy: Collinsella
  MG14-39 HNH domain

SEQ ID NO: 4351 - protein, 172 aa, Unknown
  Description of Unknown: uncultivated organism
  MG14-40 HNH domain
DLKRSKHEKAIIAATNKANKDSNEQVKKDLVAFYGLPNDAHVSSTDFEKMWLYREQFGQDPYTGKGINLERMLNDRDYVEIDHILPFSRSCDDSKSNKVLCLTKSNRDKANRTPYEWMTSGEPSAPDFGDFCGRMDAWAGKGKSAHYTKSKLSKLKNSTFGKEEQKFIDRNL

SEQ ID NO: 4352 - protein, 163 aa, Unknown
  Description of Unknown: uncultivated organism with predicted taxonomy: Collinsella
  MG14-41 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSF

SEQ ID NO: 4353 - protein, 163 aa, Unknown
  Description of Unknown: uncultivated organism with predicted taxonomy: Collinsella
  MG14-42 HNH domain
ELRLPQRAKDEIAKANKKNEKNRERIAGQIAELRGCTADEVTGKQIEKYRLWEEQECFDLYTGTKIEVDRLISDDTYTQIDHILPFSRTGENSRNNKVLVLAKSNQDKREQTPYEWMSHDGAPSWNAFERRVQENQKLSRRKKNFLLEKDLDTKEGEFLARSF

SEQ ID NO: 4354 - protein, 163 aa, Unknown
  Description of Unknown: uncultivated organism with predicted taxonomy: Collinsella
  MG14-43 HNH domain
ELRLPQRAKDEIAKANKKNEKNSERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4355 - protein, 163 aa, Unknown; identical to SEQ ID NO: 4352
  Description of Unknown: uncultivated organism with predicted taxonomy: Olsenella mediterranea
  MG14-44 HNH domain

SEQ ID NO: 4356 - protein, 163 aa, Unknown; identical to SEQ ID NO: 4352
  Description of Unknown: uncultivated organism with predicted taxonomy: Collinsella
  MG14-45 HNH domain

SEQ ID NO: 4357 - protein, 163 aa, Unknown; identical to SEQ ID NO: 4347
  Description of Unknown: uncultivated organism with predicted taxonomy: Collinsella
  MG14-46 HNH domain

SEQ ID NO: 4358 - protein, 172 aa, Unknown
  Description of Unknown: uncultivated organism with predicted taxonomy: Collinsella sp. AM13-34
  MG14-47 HNH domain
DLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNL

SEQ ID NO: 4359 - protein, 163 aa, Unknown; identical to SEQ ID NO: 4347
  Description of Unknown: uncultivated organism with predicted taxonomy: Collinsella
  MG14-48 HNH domain

SEQ ID NO: 4360 - protein, 172 aa, Unknown
  Description of Unknown: uncultivated organism with predicted taxonomy: Collinsella sp. AF20-14LB
  MG14-49 HNH domain
DLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNL

SEQ ID NO: 4361 - protein, 165 aa, Unknown
  Description of Unknown: uncultivated organism with predicted taxonomy: Libanicoccus massiliensis
  MG14-50 HNH domain
ELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTILDEDTQEGFINRNL

SEQ ID NO: 4362 - protein, 163 aa, Unknown
  Description of Unknown: uncultivated organism with predicted taxonomy: Collinsella
  MG14-51 HNH domain
ELRLPQRAKDEIAKANKKNEKNRERIAGQIAELRGCTADEVTGKQIEKYRLWEEQKCFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4363 - protein, 163 aa, Unknown
  Description of Unknown: uncultivated organism with predicted taxonomy: Collinsella
  MG14-52 HNH domain
ELRLPRRAKDEIAKANKKNEKNRERIARQIAELRGCTADEVTGKQIEKYRLWEEQECFDLYTGAKIEIGRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4364 - protein, 165 aa, Unknown
  Description of Unknown: uncultivated organism with predicted taxonomy: Olsenella sp. KH3B4
  MG14-53 HNH domain
DLKMSNKEKDLVDKRNRENEAAKKKWAKTAADILGIEPEEVPGRIVRKLIMREEQDNWDLYTGDAIDLERLVRDDRYCEIDHILPYSRTCDDSRANKVLVLSKSNQDKRERTPYEWMTSGEAGAPSWDEYRARVMALVKNPHKRANHLNTDLGEEAQAKFLARNL

SEQ ID NO: 4365 - protein, 165 aa, Unknown
  Description of Unknown: uncultivated organism with predicted taxonomy: Olsenella sp. KH3B4
  MG14-54 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNL

SEQ ID NO: 4366 - protein, 172 aa, Unknown
  Description of Unknown: uncultivated organism with predicted taxonomy: Collinsella
  MG14-55 HNH domain
DLKRTEHERKLITSGNIYNRRTNEKAKDDIVEYLGLSDADQVRGRDIDKVRLYNEQGGKDPYTGQGIDFGRMLTEKGYVEIDHILPFSRSCDNARTNKVLVLTKSNRNKSNRTPYEWMTSGEPTAPNWDEFCIRMDVWASGKEPKHYYSSKLAKLKEDNFTNNIDSFISRNL

SEQ ID NO: 4367 - protein, 163 aa, Unknown
  Description of Unknown: uncultivated organism with predicted taxonomy: Collinsella
  MG14-56 HNH domain
ELRLPRRAKDEIAKANKKNEKNRERIARQIAELRGCTADEVTGKQIEKYRLWEEQECFDLYTGAKIEVGRLISDDTYTQIDHILPFSRTGENSRNNKVLVLAKSNQDKREQTPYEWMSHDGAPSWDAFERRVQENQKLGRRKKNFLLEKDLDTKEGEFLARSF

SEQ ID NO: 4368 - protein, 165 aa, Unknown
  Description of Unknown: uncultivated organism with predicted taxonomy: Olsenella
  MG14-57 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNL

SEQ ID NO: 4369 - protein, 163 aa, Unknown; identical to SEQ ID NO: 4347
  Description of Unknown: uncultivated organism with predicted taxonomy: Collinsella
  MG14-58 HNH domain

SEQ ID NO: 4370 - protein, 163 aa, Unknown; identical to SEQ ID NO: 4349
  Description of Unknown: uncultivated organism with predicted taxonomy: Collinsella
  MG14-59 HNH domain

SEQ ID NO: 4371 - protein, 163 aa, Unknown; identical to SEQ ID NO: 4367
  Description of Unknown: uncultivated organism with predicted taxonomy: Collinsella
  MG14-60 HNH domain

SEQ ID NO: 4372 - protein, 163 aa, Unknown
  Description of Unknown: uncultivated organism with predicted taxonomy: Collinsella
  MG14-61 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSF

SEQ ID NO: 4373 - protein, 163 aa, Unknown; identical to SEQ ID NO: 4352
  Description of Unknown: uncultivated organism with predicted taxonomy: Collinsella
  MG14-62 HNH domain

SEQ ID NO: 4374 - protein, 172 aa, Unknown
  Description of Unknown: uncultivated organism with predicted taxonomy: Collinsella
  MG14-63 HNH domain
DLKRSKHEREIVAESNRARLELNEQAKRDIIEFLGLPDDHHVRGRDLALVKLYREQGGKDPYTGVGIDFRRMLEEHGYAEIDHILPVSRTCDDSQANKVLCLTKSNRDKSNRSPYEWMTSGEASAPDWNGFCGRMERWAKMCEPRRYARKKLANLTCENLAERAGNFIDRNL

SEQ ID NO: 4375 - protein, 163 aa, Unknown
  Description of Unknown: uncultivated organism with predicted taxonomy: Collinsella
  MG14-64 HNH domain
ELRLPQRAKDDIAKAHKRNEKNRERIAGQIAELRGCSPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEENLEAKEGEFLARSF

SEQ ID NO: 4376 - protein, 163 aa, Unknown; identical to SEQ ID NO: 4367
  Description of Unknown: uncultivated organism with predicted taxonomy: Collinsella
  MG14-65 HNH domain

SEQ ID NO: 4377 - protein, 163 aa, Unknown; identical to SEQ ID NO: 4347
  Description of Unknown: uncultivated organism with predicted taxonomy: Collinsella
  MG14-66 HNH domain

SEQ ID NO: 4378 - protein, 163 aa, Unknown; identical to SEQ ID NO: 4347
  Description of Unknown: uncultivated organism with predicted taxonomy: Collinsella
  MG14-67 HNH domain

SEQ ID NO: 4379 - protein, 163 aa, Unknown; identical to SEQ ID NO: 4347
  Description of Unknown: uncultivated organism with predicted taxonomy: Collinsella
  MG14-68 HNH domain

SEQ ID NO: 4380 - protein, 167 aa, Unknown
  Description of Unknown: uncultivated organism with predicted taxonomy: Olsenella
  MG14-69 HNH domain
DLKRSKHEKDLINKRNRENERKNKQWRAQIAEEQGIDPDEVRPKLLRKIALWEEQDNFDIYTGHKIEFDRMISDDKYCEIDHVLPYSRTCDDSRNNKVLVLAKSNQDKRERTPYEWMTQDARKGAPNWDEYQARVIANHHISPRKRRYLLDNNLGPDQESDFLSRNL

SEQ ID NO: 4381 - protein, 165 aa, Unknown
  Description of Unknown: uncultivated organism with predicted taxonomy: Collinsella tanakaei
  MG14-70 HNH domain
ELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNM

SEQ ID NO: 4382 - protein, 163 aa, Unknown; identical to SEQ ID NO: 4347
  Description of Unknown: uncultivated organism with predicted taxonomy: Collinsella
  MG14-71 HNH domain

SEQ ID NO: 4383 - protein, 171 aa, Unknown
  Description of Unknown: uncultivated organism with predicted taxonomy: Atopobium sp. ICM42b
  MG14-72 HNH domain
DIAKSAKEKSKIAKGQNENRKENERIKDKIAEILHIDQSEVTGKQITKMKLYEEQGGKDIYTGEGLGDIAFAGGRRFLIDDNYCEIDHVLPYSRSADDLKSNKVLVLAKSNQEKGNRTPYEWMNSNDGSHPNWEQFCLRVLSNVRLSDGKKSKLLEENFAEKEVSFIKRNM

SEQ ID NO: 4384 - protein, 163 aa, Unknown
  Description of Unknown: uncultivated organism with predicted taxonomy: Collinsella
  MG14-73 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDSKEGEFLARSF

SEQ ID NO: 4385 - protein, 172 aa, Unknown
  Description of Unknown: uncultivated organism with predicted taxonomy: Collinsella
  MG14-74 HNH domain
DLKRTEHEKKLITSGNIYNRRTNEKAKDDIVEYLGLSEADQVRGRDIDKVRLYNEQGGKDPYTGQGIDFGRMLTEKGYVEIDHILPFSRSCDNARTNKVLVLTKSNRDKSNRTPYEWMTSGEPTAPNWDEFCIRMDVWASGKEPKHYYSSKLAKLKEDNFTNNIDSFISRNL

SEQ ID NO: 4386 - protein, 172 aa, Unknown
  Description of Unknown: uncultivated organism with predicted taxonomy: Collinsella sp. AM13-34
  MG14-75 HNH domain
DLKRSKHEREIVAESNRARLELNEQAKRDIIEFLGLPDDHHVRGRDLALVKLYREQGGKDPYTGAGIDFRRMLEEHGYAEIDHILPVSRTCDDSQANKVLCLTKSNRDKSNRSPYEWMTSGEASAPDWGEFCGRMERWAKMCEPRRYARKKLANLTCENLTERAGNFIDRNL

SEQ ID NO: 4387 - protein, 163 aa, Unknown; identical to SEQ ID NO: 4347
  Description of Unknown: uncultivated organism with predicted taxonomy: Collinsella
  MG14-76 HNH domain

SEQ ID NO: 4388 - protein, 163 aa, Unknown
  Description of Unknown: uncultivated organism with predicted taxonomy: Collinsella
  MG14-77 HNH domain
ELRLPQRAKDEIAKTNKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4389 - protein, 163 aa, Unknown
  Description of Unknown: uncultivated organism with predicted taxonomy: Collinsella
  MG14-78 HNH domain
ELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSF

SEQ ID NO: 4390 - protein, 163 aa, Unknown; identical to SEQ ID NO: 4347
  Description of Unknown: uncultivated organism with predicted taxonomy: Collinsella
  MG14-79 HNH domain

SEQ ID NO: 4391 - protein, 163 aa, Unknown; identical to SEQ ID NO: 4313
  Description of Unknown: uncultivated organism with predicted taxonomy: Coriobacteriales
  MG14-80 HNH domain

SEQ ID NO: 4392 - protein, 163 aa, Unknown; identical to SEQ ID NO: 4389
  Description of Unknown: uncultivated organism with predicted taxonomy: Collinsella
  MG14-82 HNH domain

SEQ ID NO: 4393 - protein, 163 aa, Unknown; identical to SEQ ID NO: 4321
  Description of Unknown: uncultivated organism with predicted taxonomy: Collinsella
  MG14-83 HNH domain

SEQ ID NO: 4394 - protein, 165 aa, Unknown; identical to SEQ ID NO: 4325
  Description of Unknown: uncultivated organism with predicted taxonomy: Olsenella
  MG14-84 HNH domain

SEQ ID NO: 4395 - protein, 163 aa, Unknown; identical to SEQ ID NO: 4347
  Description of Unknown: uncultivated organism with predicted taxonomy: Collinsella
  MG14-85 HNH domain

SEQ ID NO: 4396 - protein, 163 aa, Unknown; identical to SEQ ID NO: 4352
  Description of Unknown: uncultivated organism with predicted taxonomy: Collinsella
  MG14-87 HNH domain

SEQ ID NO: 4397 - protein, 163 aa, Unknown; identical to SEQ ID NO: 4352
  Description of Unknown: uncultivated organism with predicted taxonomy: Collinsella
  MG14-88 HNH domain

SEQ ID NO: 4398 - protein, 163 aa, Unknown; identical to SEQ ID NO: 4347
  Description of Unknown: uncultivated organism with predicted taxonomy: Collinsella
  MG14-89 HNH domain

SEQ ID NO: 4399 - protein, 163 aa, Unknown
  Description of Unknown: uncultivated organism with predicted taxonomy: Coriobacteriia
  MG14-90 HNH domain
ELRLPQRAKDEIAKANKKNEENRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4400 - protein, 165 aa, Unknown; identical to SEQ ID NO: 4381
  Description of Unknown: uncultivated organism with predicted taxonomy: Collinsella tanakaei
  MG14-91 HNH domain

SEQ ID NO: 4401 - protein, 163 aa, Unknown; identical to SEQ ID NO: 4352
  Description of Unknown: uncultivated organism with predicted taxonomy: Collinsella
  MG14-92 HNH domain

SEQ ID NO: 4402 - protein, 163 aa, Unknown; identical to SEQ ID NO: 4352
  Description of Unknown: uncultivated organism with predicted taxonomy: Collinsella
  MG14-93 HNH domain

SEQ ID NO: 4403 - protein, 163 aa, Unknown; identical to SEQ ID NO: 4347
  Description of Unknown: uncultivated organism with predicted taxonomy: Collinsella
  MG14-94 HNH domain

SEQ ID NO: 4404 - protein, 172 aa, Unknown
  Description of Unknown: uncultivated organism with predicted taxonomy: Collinsella
  MG14-95 HNH domain
DLKRSKHEREIVAESNRARLELNEQAKRDIIEFLGLPDDHHVRGRDLALVKLYREQGGKDPYTGAGIDFRRMLEEHGYAEIDHILPVSRTCDDSQANKALCLTKSNRDKSNRSPYEWMTSGEASAPDWGEFCGRMERWAKMCETRRYARKKLANLTCENLAERAGNFIDRNL

SEQ ID NO: 4405 - protein, 163 aa, Unknown; identical to SEQ ID NO: 4347
  Description of Unknown: uncultivated organism with predicted taxonomy: Collinsella
  MG14-96 HNH domain

SEQ ID NO: 4406 - protein, 163 aa, Unknown; identical to SEQ ID NO: 4347
  Description of Unknown: uncultivated organism with predicted taxonomy: Collinsella
  MG14-97 HNH domain

SEQ ID NO: 4407 - protein, 163 aa, Unknown
  Description of Unknown: uncultivated organism with predicted taxonomy: Collinsella
  MG14-98 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDDAPSWDAFERRVQENQKLSRRKKNFLLEKDLDTKEGEFLARSF

SEQ ID NO: 4408 - protein, 165 aa, Unknown; identical to SEQ ID NO: 4320
  Description of Unknown: uncultivated organism with predicted taxonomy: Olsenella
  MG14-99 HNH domain

SEQ ID NO: 4409 - protein, 163 aa, Unknown; identical to SEQ ID NO: 4347
  Description of Unknown: uncultivated organism with predicted taxonomy: Collinsella
  MG14-100 HNH domain

SEQ ID NO: 4410 - protein, 172 aa, Unknown; identical to SEQ ID NO: 4358
  Description of Unknown: uncultivated organism with predicted taxonomy: Eggerthella sp. AM16-19
  MG14-101 HNH domain

SEQ ID NO: 4411 - protein, 165 aa, Unknown; identical to SEQ ID NO: 4365
  Description of Unknown: uncultivated organism with predicted taxonomy: Olsenella sp. KH3B4
  MG14-102 HNH domain

SEQ ID NO: 4412 - protein, 163 aa, Unknown
  Description of Unknown: uncultivated organism with predicted taxonomy: Collinsella
  MG14-103 HNH domain
ELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSF

SEQ ID NO: 4413 - protein, 163 aa, Unknown
  Description of Unknown: uncultivated organism with predicted taxonomy: Collinsella
  MG14-104 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDAKEGDFLARSF

SEQ ID NO: 4414 - protein, 163 aa, Unknown; identical to SEQ ID NO: 4330
  Description of Unknown: uncultivated organism with predicted taxonomy: Collinsella
  MG14-105 HNH domain

SEQ ID NO: 4415 - protein, 163 aa, Unknown; identical to SEQ ID NO: 4363
  Description of Unknown: uncultivated organism with predicted taxonomy: Collinsella
  MG14-106 HNH domain

SEQ ID NO: 4416 - protein, 163 aa, Unknown; identical to SEQ ID NO: 4313
  Description of Unknown: uncultivated organism with predicted taxonomy: Collinsella
  MG14-107 HNH domain

SEQ ID NO: 4417 - protein, 171 aa, Unknown
  Description of Unknown: uncultivated organism with predicted taxonomy: Atopobium sp. ICM42b
  MG14-108 HNH domain
DIAKSAKEKSKIAKGQNENRKENERIKDKIAKLLHIDQSEVTGKQITKMKLYEEQGGKDIYTGESLGDIAFAGGRRFLIDDNYCEIDHVLPYSRSADDLKSNKVLVLAKSNQEKGNRTPYEWMNSNDGNHPNWEQFCLRVTSNVRLSDSKKSKLLEENFAEKETSFIKRNM

SEQ ID NO: 4418 - protein, 171 aa, Unknown
  Description of Unknown: uncultivated organism with predicted taxonomy: Atopobium sp. ICM42b
  MG14-109 HNH domain
ELTKSPKQREKIAKEQNKNRKENERIRKEIAKYLEIDSSCVTKKQILKKKLYEEQKGLDVYTGESLEPSLHADDLTYLKDDSYCQIDHILPYSRSADDSIANKVLVLAKSNQDKGNRTPYEWMTSGHEHHLSWEEFAIRVSTNLSISDSKKWRLLEEDFNKKEVQFMNRNL

SEQ ID NO: 4419 - protein, 163 aa, Unknown; identical to SEQ ID NO: 4352
  Description of Unknown: uncultivated organism with predicted taxonomy: Collinsella
  MG14-110 HNH domain

SEQ ID NO: 4420 - protein, 172 aa, Unknown
  Description of Unknown: uncultivated organism
  MG14-111 HNH domain
DLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNL

SEQ ID NO: 4421 - protein, 163 aa, Unknown
  Description of Unknown: uncultivated organism with predicted taxonomy: Collinsella
  MG14-112 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSF

SEQ ID NO: 4422 - protein, 163 aa, Unknown; identical to SEQ ID NO: 4347
  Description of Unknown: uncultivated organism with predicted taxonomy: Collinsella
  MG14-113 HNH domain

SEQ ID NO: 4423 - protein, 163 aa, Unknown; identical to SEQ ID NO: 4347
  Description of Unknown: uncultivated organism with predicted taxonomy: Collinsella
  MG14-114 HNH domain

SEQ ID NO: 4424 - protein, 163 aa, Unknown; identical to SEQ ID NO: 4347
  Description of Unknown: uncultivated organism with predicted taxonomy: Collinsella
  MG14-115 HNH domain

SEQ ID NO: 4425 - protein, 163 aa, Unknown
  Description of Unknown: uncultivated organism with predicted taxonomy: Collinsella
  MG14-116 HNH domain
ELRLPQRAKDEIAKANKKNEKNRERIAGQIAELRGCAADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4426 - protein, 163 aa, Unknown; identical to SEQ ID NO: 4347
  Description of Unknown: uncultivated organism with predicted taxonomy: Collinsella
  MG14-117 HNH domain

SEQ ID NO: 4427 - protein, 165 aa, Unknown
  Description of Unknown: uncultivated organism with predicted taxonomy: Olsenella sp. KCTC 15699
  MG14-118 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNL

SEQ ID NO: 4428 - protein, 163 aa, Unknown; identical to SEQ ID NO: 4347
  Description of Unknown: uncultivated organism with predicted taxonomy: Collinsella
  MG14-119 HNH domain

SEQ ID NO: 4429 - protein, 165 aa, Unknown; identical to SEQ ID NO: 4381
  Description of Unknown: uncultivated organism with predicted taxonomy: Collinsella tanakaei
  MG14-120 HNH domain

SEQ ID NO: 4430 - protein, 163 aa, Unknown
  Description of Unknown: uncultivated organism with predicted taxonomy: Collinsella
  MG14-121 HNH domain
ELRLPQRAKDEIAKANKKNKKNRERIAGQIAELRGCTIDEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSF

SEQ ID NO: 4431 - protein, 165 aa, Unknown
  Description of Unknown: uncultivated organism with predicted taxonomy: Olsenella
  MG14-122 HNH domain
DLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANHLNTDLGPETQAKFLARNL

SEQ ID NO: 4432 - protein, 163 aa, Unknown; identical to SEQ ID NO: 4347
  Description of Unknown: uncultivated organism with predicted taxonomy: Olsenella mediterranea
  MG14-123 HNH domain

SEQ ID NO: 4433 - protein, 163 aa, Unknown; identical to SEQ ID NO: 4347
  Description of Unknown: uncultivated organism with predicted taxonomy: Collinsella
  MG14-124 HNH domain

SEQ ID NO: 4434 - protein, 163 aa, Unknown
  Description of Unknown: uncultivated organism with predicted taxonomy: Collinsella
  MG14-125 HNH domain
ELRLPQRAKVEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4435 - protein, 165 aa, Unknown
  Description of Unknown: uncultivated organism with predicted taxonomy: Libanicoccus massiliensis
  MG14-126 HNH domain
ELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNL

SEQ ID NO: 4436 - protein, 163 aa, Unknown; identical to SEQ ID NO: 4347
  Description of Unknown: uncultivated organism with predicted taxonomy: Collinsella
  MG14-127 HNH domain

SEQ ID NO: 4437 - protein, 163 aa, Unknown; identical to SEQ ID NO: 4352
  Description of Unknown: uncultivated organism with predicted taxonomy: Collinsella
  MG14-128 HNH domain

SEQ ID NO: 4438 - protein, 163 aa, Unknown; identical to SEQ ID NO: 4434
  Description of Unknown: uncultivated organism with predicted taxonomy: Collinsella
  MG14-129 HNH domain

SEQ ID NO: 4439 - protein, 165 aa, Unknown; identical to SEQ ID NO: 4336
  Description of Unknown: uncultivated organism with predicted taxonomy: Olsenella sp. KH3B4
  MG14-130 HNH domain

SEQ ID NO: 4440 - protein, 163 aa, Unknown; identical to SEQ ID NO: 4352
  Description of Unknown: uncultivated organism with predicted taxonomy: Collinsella
  MG14-131 HNH domain

SEQ ID NO: 4441 - protein, 163 aa, Unknown
  Description of Unknown: uncultivated organism with predicted taxonomy: Collinsella
  MG14-132 HNH domain
ELRLPQRAKDEIAKANKKNEKNRERIAGQIAELRGCTADEVTGKQIEKYRLWEEQECFDLYTGAKIEVDRLINDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4442 - protein, 163 aa, Unknown; identical to SEQ ID NO: 4347
  Description of Unknown: uncultivated organism with predicted taxonomy: Collinsella
  MG14-133 HNH domain

SEQ ID NO: 4443 - protein, 163 aa, Unknown; identical to SEQ ID NO: 4347
  Description of Unknown: uncultivated organism with predicted taxonomy: Collinsella
  MG14-135 HNH domain

SEQ ID NO: 4444 - protein, 163 aa, Unknown; identical to SEQ ID NO: 4421
  Description of Unknown: uncultivated organism with predicted taxonomy: Collinsella
  MG14-136 HNH domain

SEQ ID NO: 4445 - protein, 172 aa, Unknown
  Description of Unknown: uncultivated organism with predicted taxonomy: Clostridiales
  MG14-137 HNH domain
DLKRSKREKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNL

SEQ ID NO: 4446 - protein, 163 aa, Unknown; identical to SEQ ID NO: 4313
  Description of Unknown: uncultivated organism with predicted taxonomy: Collinsella
  MG14-138 HNH domain

SEQ ID NO: 4447 - protein, 163 aa, Unknown; identical to SEQ ID NO: 4352
  Description of Unknown: uncultivated organism with predicted taxonomy: Collinsella
  MG14-139 HNH domain

SEQ ID NO: 4448 - protein, 163 aa, Unknown; identical to SEQ ID NO: 4313
  Description of Unknown: uncultivated organism with predicted taxonomy: Collinsella
  MG14-140 HNH domain

SEQ ID NO: 4449 - protein, 165 aa, Unknown; identical to SEQ ID NO: 4365
  Description of Unknown: uncultivated organism with predicted taxonomy: Olsenella sp. KH3B4
  MG14-141 HNH domain

SEQ ID NO: 4450 - protein, 163 aa, Unknown; identical to SEQ ID NO: 4352
  Description of Unknown: uncultivated organism with predicted taxonomy: Collinsella
  MG14-142 HNH domain

SEQ ID NO: 4451 - protein, 163 aa, Unknown; identical to SEQ ID NO: 4347
  Description of Unknown: uncultivated organism with predicted taxonomy: Collinsella
  MG14-143 HNH domain

SEQ ID NO: 4452 - protein, 172 aa, Unknown; identical to SEQ ID NO: 4358
  Description of Unknown: uncultivated organism with predicted taxonomy: Collinsella
  MG14-144 HNH domain

SEQ ID NO: 4453 - protein, 165 aa, Unknown; identical to SEQ ID NO: 4325
  Description of Unknown: uncultivated organism with predicted taxonomy: Olsenella sp. KCTC 15699
  MG14-145 HNH domain

SEQ ID NO: 4454 - protein, 165 aa, Unknown
  Description of Unknown: uncultivated organism with predicted taxonomy: Olsenella
  MG14-146 HNH domain
DLKMSNKEKSLVDKRNRENAASNKKWATTAAGILGCTPEEVPGRIIRKLILREEQGEKDLYTGDSIDLEHLVRDDRYCEIDHILPYSCTCDDSRANKVLVLSKSNQDKRERTPYEWMTSGEAGAPSWDSYRARVMAQVKNPRKRANYLNTDLGPETQAKFLARNL

SEQ ID NO: 4455 - protein, 167 aa, Unknown; identical to SEQ ID NO: 4346
  Description of Unknown: uncultivated organism with predicted taxonomy: Olsenella sp. KH3B4
  MG14-147 HNH domain

SEQ ID NO: 4456 - protein, 163 aa, Unknown; identical to SEQ ID NO: 4347
  Description of Unknown: uncultivated organism with predicted taxonomy: Olsenella mediterranea
  MG14-148 HNH domain

SEQ ID NO: 4457 - protein, 163 aa, Unknown; identical to SEQ ID NO: 4352
  Description of Unknown: uncultivated organism with predicted taxonomy: Collinsella
  MG14-149 HNH domain

SEQ ID NO: 4458 - protein, 163 aa, Unknown; identical to SEQ ID NO: 4347
  Description of Unknown: uncultivated organism with predicted taxonomy: Collinsella
  MG14-150 HNH domain

SEQ ID NO: 4459 - protein, 163 aa, Unknown; identical to SEQ ID NO: 4352
  Description of Unknown: uncultivated organism with predicted taxonomy: Collinsella
  MG14-151 HNH domain

SEQ ID NO: 4460 - protein, 163 aa, Unknown; identical to SEQ ID NO: 4323
  Description of Unknown: uncultivated organism with predicted taxonomy: Collinsella
  MG14-152 HNH domain

SEQ ID NO: 4461 - protein, 163 aa, Unknown; identical to SEQ ID NO: 4330
  Description of Unknown: uncultivated organism with predicted taxonomy: Coriobacteriales
  MG14-153 HNH domain

SEQ ID NO: 4462 - protein, 165 aa, Unknown; identical to SEQ ID NO: 4368
  Description of Unknown: uncultivated organism with predicted taxonomy: Olsenella
  MG14-154 HNH domain

SEQ ID NO: 4463 - protein, 165 aa, Unknown; identical to SEQ ID NO: 4345
  Description of Unknown: uncultivated organism with predicted taxonomy: Olsenella
  MG14-155 HNH domain

SEQ ID NO: 4464 - protein, 165 aa, Unknown; identical to SEQ ID NO: 4435
  Description of Unknown: uncultivated organism with predicted taxonomy: Libanicoccus massiliensis
  MG14-156 HNH domain

SEQ ID NO: 4465 - protein, 163 aa, Unknown; identical to SEQ ID NO: 4347
  Description of Unknown: uncultivated organism with predicted taxonomy: Collinsella
  MG14-157 HNH domain

SEQ ID NO: 4466 - protein, 163 aa, Unknown; identical to SEQ ID NO: 4323
  Description of Unknown: uncultivated organism with predicted taxonomy: Collinsella
  MG14-158 HNH domain

SEQ ID NO: 4467 - protein, 163 aa, Unknown; identical to SEQ ID NO: 4347
  Description of Unknown: uncultivated organism with predicted taxonomy: Collinsella
  MG14-159 HNH domain

SEQ ID NO: 4468 - protein, 163 aa, Unknown; identical to SEQ ID NO: 4367
  Description of Unknown: uncultivated organism with predicted taxonomy: Collinsella
  MG14-160 HNH domain

SEQ ID NO: 4469 - protein, 163 aa, Unknown; identical to SEQ ID NO: 4367
  Description of Unknown: uncultivated organism with predicted taxonomy: Collinsella
  MG14-161 HNH domain

SEQ ID NO: 4470 - protein, 165 aa, Unknown; identical to SEQ ID NO: 4336
  Description of Unknown: uncultivated organism with predicted taxonomy: Olsenella
  MG14-162 HNH domain

SEQ ID NO: 4471 - protein, 163 aa, Unknown; identical to SEQ ID NO: 4367
  Description of Unknown: uncultivated organism with predicted taxonomy: Collinsella
  MG14-163 HNH domain

SEQ ID NO: 4472 - protein, 165 aa, Unknown; identical to SEQ ID NO: 4319
  Description of Unknown: uncultivated organism with predicted taxonomy: Olsenella
  MG14-164 HNH domain

SEQ ID NO: 4473 - protein, 163 aa, Unknown; identical to SEQ ID NO: 4323
  Description of Unknown: uncultivated organism with predicted taxonomy: Collinsella
  MG14-165 HNH domain

SEQ ID NO: 4474 - protein, 163 aa, Unknown; identical to SEQ ID NO: 4347
  Description of Unknown: uncultivated organism with predicted taxonomy: Collinsella sp. AM17-1
  MG14-166 HNH domain

SEQ ID NO: 4475 - protein, 163 aa, Unknown; identical to SEQ ID NO: 4352
  Description of Unknown: uncultivated organism with predicted taxonomy: Collinsella
  MG14-167 HNH domain

SEQ ID NO: 4476 - protein, 165 aa, Unknown; identical to SEQ ID NO: 4329
  Description of Unknown: uncultivated organism with predicted taxonomy: Olsenella sp. KH3B4
  MG14-168 HNH domain

SEQ ID NO: 4477 - protein, 165 aa, Unknown; identical to SEQ ID NO: 4325
  Description of Unknown: uncultivated organism with predicted taxonomy: Olsenella
  MG14-169 HNH domain

SEQ ID NO: 4478 - protein, 165 aa, Unknown; identical to SEQ ID NO: 4343
  Description of Unknown: uncultivated organism with predicted taxonomy: Olsenella sp. KH3B4
  MG14-170 HNH domain

SEQ ID NO: 4479 - protein, 161 aa, Unknown; identical to SEQ ID NO: 4342
  Description of Unknown: uncultivated organism with predicted taxonomy: Coriobacteriia bacterium
  MG14-171 HNH domain

SEQ ID NO: 4480 - protein, 163 aa, Unknown; identical to SEQ ID NO: 4375
  Description of Unknown: uncultivated organism with predicted taxonomy: Collinsella
  MG14-172 HNH domain

SEQ ID NO: 4481 - protein, 163 aa, Unknown; identical to SEQ ID NO: 4384
  Description of Unknown: uncultivated organism with predicted taxonomy: Collinsella
  MG14-173 HNH domain

SEQ ID NO: 4482 - protein, 163 aa, Unknown
  Description of Unknown: uncultivated organism with predicted taxonomy: Collinsella
  MG14-174 HNH domain
ELRLPQRAKDEIAKANKKNEKNRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSF

SEQ ID NO: 4483 - protein, 163 aa, Unknown; identical to SEQ ID NO: 4349
  Description of Unknown: uncultivated organism with predicted taxonomy: Collinsella
  MG14-175 HNH domain

SEQ ID NO: 4484 - protein, 163 aa, Unknown; identical to SEQ ID NO: 4349
  Description of Unknown: uncultivated organism with predicted taxonomy: Collinsella aerofaciens
  MG14-176 HNH domain

SEQ ID NO: 4485 - protein, 163 aa, Unknown; identical to SEQ ID NO: 4347
  Description of Unknown: uncultivated organism with predicted taxonomy: Collinsella
  MG14-177 HNH domain

SEQ ID NO: 4486 - protein, 165 aa, Unknown
  Description of Unknown: uncultivated organism with predicted taxonomy: Olsenella sp. GAM18
  MG14-178 HNH domain
DLKMSNKEKILVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNL

SEQ ID NO: 4487 - protein, 163 aa, Unknown; identical to SEQ ID NO: 4353
  Description of Unknown: uncultivated organism with predicted taxonomy: Collinsella
  MG14-179 HNH domain

SEQ ID NO: 4488 - protein, 163 aa, Unknown; identical to SEQ ID NO: 4347
  Description of Unknown: uncultivated organism with predicted taxonomy: Collinsella
  MG14-180 HNH domain

SEQ ID NO: 4489 - protein, 167 aa, Unknown; identical to SEQ ID NO: 4380
  Description of Unknown: uncultivated organism with predicted taxonomy: Olsenella
  MG14-181 HNH domain

SEQ ID NO: 4490 - protein, 163 aa, Unknown; identical to SEQ ID NO: 4347
  Description of Unknown: uncultivated organism with predicted taxonomy: Olsenella mediterranea
  MG14-182 HNH domain

SEQ ID NO: 4491 - protein, 163 aa, Unknown; identical to SEQ ID NO: 4347
  Description of Unknown: uncultivated organism with predicted taxonomy: Collinsella
  MG14-183 HNH domain

SEQ ID NO: 4492 - protein, 165 aa, Unknown; identical to SEQ ID NO: 4431
  Description of Unknown: uncultivated organism with predicted taxonomy: Olsenella
  MG14-184 HNH domain

SEQ ID NO: 4493 - protein, 163 aa, Unknown; identical to SEQ ID NO: 4347
  Description of Unknown: uncultivated organism with predicted taxonomy: Collinsella
  MG14-185 HNH domain

SEQ ID NO: 4494 - protein, 163 aa, Unknown; identical to SEQ ID NO: 4347
  Description of Unknown: uncultivated organism with predicted taxonomy: Collinsella
  MG14-186 HNH domain

SEQ ID NO: 4495 - protein, 163 aa, Unknown; identical to SEQ ID NO: 4399
  Description of Unknown: uncultivated organism with predicted taxonomy: Coriobacteriales
  MG14-187 HNH domain

SEQ ID NO: 4496 - protein, 163 aa, Unknown; identical to SEQ ID NO: 4441
  Description of Unknown: uncultivated organism with predicted taxonomy: Collinsella
  MG14-188 HNH domain

SEQ ID NO: 4497 - protein, 163 aa, Unknown; identical to SEQ ID NO: 4352
  Description of Unknown: uncultivated organism with predicted taxonomy: Collinsella
  MG14-189 HNH domain

SEQ ID NO: 4498 - protein, 163 aa, Unknown; identical to SEQ ID NO: 4347
  Description of Unknown: uncultivated organism with predicted taxonomy: Collinsella
  MG14-190 HNH domain

SEQ ID NO: 4499 - protein, 163 aa, Unknown; identical to SEQ ID NO: 4352
  Description of Unknown: uncultivated organism with predicted taxonomy: Collinsella
  MG14-191 HNH domain

SEQ ID NO: 4500 - protein, 163 aa, Unknown; identical to SEQ ID NO: 4347
  Description of Unknown: uncultivated organism with predicted taxonomy: Collinsella
  MG14-192 HNH domain

SEQ ID NO: 4501 - protein, 163 aa, Unknown; identical to SEQ ID NO: 4412
  Description of Unknown: uncultivated organism with predicted taxonomy: Collinsella
  MG14-193 HNH domain

SEQ ID NO: 4502 - protein, 165 aa, Unknown; identical to SEQ ID NO: 4364
  Description of Unknown: uncultivated organism with predicted taxonomy: Olsenella
  MG14-194 HNH domain

SEQ ID NO: 4503 - protein, 163 aa, Unknown; identical to SEQ ID NO: 4349
  Description of Unknown: uncultivated organism with predicted taxonomy: Collinsella
  MG14-195 HNH domain

SEQ ID NO: 4504 - protein, 172 aa, Unknown; identical to SEQ ID NO: 4374
  Description of Unknown: uncultivated organism with predicted taxonomy: Collinsella
  MG14-196 HNH domain

SEQ ID NO: 4505 - protein, 163 aa, Unknown; identical to SEQ ID NO: 4347
  Description of Unknown: uncultivated organism with predicted taxonomy: Collinsella
  MG14-197 HNH domain

SEQ ID NO: 4506 - protein, 163 aa, Unknown; identical to SEQ ID NO: 4347
  Description of Unknown: uncultivated organism with predicted taxonomy: Collinsella
  MG14-198 HNH domain

SEQ ID NO: 4507 - protein, 163 aa, Unknown; identical to SEQ ID NO: 4347
  Description of Unknown: uncultivated organism with predicted taxonomy: Collinsella
  MG14-199 HNH domain

SEQ ID NO: 4508 - protein, 163 aa, Unknown; identical to SEQ ID NO: 4352
  Description of Unknown: uncultivated organism with predicted taxonomy: Collinsella
  MG14-200 HNH domain

SEQ ID NO: 4509 - protein, 163 aa, Unknown; identical to SEQ ID NO: 4313
  Description of Unknown: uncultivated organism with predicted taxonomy: Collinsella
  MG14-201 HNH domain

SEQ ID NO: 4510 - protein, 163 aa, Unknown; identical to SEQ ID NO: 4434
  Description of Unknown: uncultivated organism with predicted taxonomy: Collinsella
  MG14-202 HNH domain

SEQ ID NO: 4511 - protein, 163 aa, Unknown; identical to SEQ ID NO: 4434
  Description of Unknown: uncultivated organism with predicted taxonomy: Collinsella
  MG14-203 HNH domain

SEQ ID NO: 4512 - protein, 163 aa, Unknown; identical to SEQ ID NO: 4352
  Description of Unknown: uncultivated organism with predicted taxonomy: Collinsella
  MG14-204 HNH domain

SEQ ID NO: 4513 - protein, 163 aa, Unknown
  Description of Unknown: uncultivated organism with predicted taxonomy: Olsenella mediterranea
  MG14-205 HNH domain
ELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDTKEGEFLARSF

SEQ ID NO: 4514 - protein, 163 aa, Unknown; identical to SEQ ID NO: 4347
  Description of Unknown: uncultivated organism with predicted taxonomy: Collinsella
  MG14-206 HNH domain

SEQ ID NO: 4515 - protein, 163 aa, Unknown; identical to SEQ ID NO: 4421
  Description of Unknown: uncultivated organism with predicted taxonomy: Collinsella
  MG14-207 HNH domain

SEQ ID NO: 4516 - protein, 165 aa, Unknown; identical to SEQ ID NO: 4365
  Description of Unknown: uncultivated organism with predicted taxonomy: Olsenella
  MG14-208 HNH domain

SEQ ID NO: 4517 - protein, 163 aa, Unknown; identical to SEQ ID NO: 4352
  Description of Unknown: uncultivated organism with predicted taxonomy: Collinsella
  MG14-209 HNH domain

SEQ ID NO: 4518 - protein, 163 aa, Unknown; identical to SEQ ID NO: 4389
  Description of Unknown: uncultivated organism with predicted taxonomy: Collinsella
  MG14-210 HNH domain

SEQ ID NO: 4519 - protein, 163 aa, Unknown; identical to SEQ ID NO: 4347
  Description of Unknown: uncultivated organism with predicted taxonomy: Collinsella
  MG14-211 HNH domain

SEQ ID NO: 4520 - protein, 172 aa, Unknown; identical to SEQ ID NO: 4404
  Description of Unknown: uncultivated organism with predicted taxonomy: Collinsella
  MG14-212 HNH domain

SEQ ID NO: 4521 - protein, 163 aa, Unknown; identical to SEQ ID NO: 4347
  Description of Unknown: uncultivated organism with predicted taxonomy: Collinsella
  MG14-213 HNH domain

SEQ ID NO: 4522 - protein, 163 aa, Unknown; identical to SEQ ID NO: 4347
  Description of Unknown: uncultivated organism with predicted taxonomy: Coriobacteriales
  MG14-214 HNH domain

SEQ ID NO: 4523 - protein, 167 aa, Unknown
  Description of Unknown: uncultivated organism with predicted taxonomy: Olsenella
  MG14-215 HNH domain
ELKQSKREKDAISKFQRKKEQANNRYREVAAGILNISPDEVSDRIIEKMAFREQQNDKDAYTGTTINLERLVTDSHYCQVDHVLPYSRTSDNSRNNRVLVLSTTNQNKRERTPFEWMNSGEANAPAWNDYKKHVLANKNYSQRKKQVYLLNENLDSETEAQFISRNL

SEQ ID NO: 4524 - protein, 163 aa, Unknown; identical to SEQ ID NO: 4347
  Description of Unknown: uncultivated organism with predicted taxonomy: Collinsella
  MG14-216 HNH domain

SEQ ID NO: 4525 - protein, 163 aa, Unknown; identical to SEQ ID NO: 4372
  Description of Unknown: uncultivated organism with predicted taxonomy: Collinsella
  MG14-217 HNH domain

SEQ ID NO: 4526 - protein, 163 aa, Unknown; identical to SEQ ID NO: 4347
  Description of Unknown: uncultivated organism with predicted taxonomy: Olsenella mediterranea
  MG14-218 HNH domain

SEQ ID NO: 4527 - protein, 163 aa, Unknown; identical to SEQ ID NO: 4352
  Description of Unknown: uncultivated organism with predicted taxonomy: Collinsella
  MG14-219 HNH domain

SEQ ID NO: 4528 - protein, 163 aa, Unknown; identical to SEQ ID NO: 4352
  Description of Unknown: uncultivated organism with predicted taxonomy: Collinsella
  MG14-220 HNH domain

SEQ ID NO: 4529 - protein, 163 aa, Unknown; identical to SEQ ID NO: 4347
  Description of Unknown: uncultivated organism with predicted taxonomy: Collinsella
  MG14-221 HNH domain

SEQ ID NO: 4530 - protein, 163 aa, Unknown; identical to SEQ ID NO: 4413
  Description of Unknown: uncultivated organism with predicted taxonomy: Collinsella
  MG14-222 HNH domain

SEQ ID NO: 4531 - protein, 172 aa, Unknown
  Description of Unknown: uncultivated organism with predicted taxonomy: Collinsella sp. AM13-34
  MG14-223 HNH domain
DLKRSKHEREIVAESNRARLELNEQAKRDIIEFLGLPDDHHVRGRDLALVKLYREQGGKDPYTGAAIDFRRMLEEHRYAEIDHILPVSRTCDDSQANKVLCLTKSNRDKSNRSPYEWMTSGEASAPDWGEFCGRMERWAKMCEPRRYARKKLANLTCENLAERAGNFIDRNL

SEQ ID NO: 4532 - protein, 163 aa, Unknown; identical to SEQ ID NO: 4347
  Description of Unknown: uncultivated organism with predicted taxonomy: Collinsella
  MG14-224 HNH domain

SEQ ID NO: 4533 - protein, 163 aa, Unknown; identical to SEQ ID NO: 4313
  Description of Unknown: uncultivated organism with predicted taxonomy: Collinsella
  MG14-225 HNH domain

SEQ ID NO: 4534 - protein, 163 aa, Unknown; identical to SEQ ID NO: 4313
  Description of Unknown: uncultivated organism with predicted taxonomy: Collinsella
  MG14-226 HNH domain

SEQ ID NO: 4535 - protein, 163 aa, Unknown; identical to SEQ ID NO: 4362
  Description of Unknown: uncultivated organism with predicted taxonomy: Collinsella
  MG14-227 HNH domain

SEQ ID NO: 4536 - protein, 165 aa, Unknown; identical to SEQ ID NO: 4381
  Description of Unknown: uncultivated organism with predicted taxonomy: Olsenella
  MG14-228 HNH domain

SEQ ID NO: 4537 - protein, 163 aa, Unknown; identical to SEQ ID NO: 4347
  Description of Unknown: uncultivated organism with predicted taxonomy: Olsenella
  MG14-229 HNH domain

SEQ ID NO: 4538 - protein, 163 aa, Unknown; identical to SEQ ID NO: 4347
  Description of Unknown: uncultivated organism with predicted taxonomy: Collinsella
  MG14-230 HNH domain

SEQ ID NO: 4539 - protein, 163 aa, Unknown; identical to SEQ ID NO: 4421
  Description of Unknown: uncultivated organism with predicted taxonomy: Collinsella
  MG14-231 HNH domain

SEQ ID NO: 4540 - protein, 163 aa, Unknown; identical to SEQ ID NO: 4352
  Description of Unknown: uncultivated organism with predicted taxonomy: Collinsella
  MG14-232 HNH domain

SEQ ID NO: 4541 - protein, 163 aa, Unknown; identical to SEQ ID NO: 4347
  Description of Unknown: uncultivated organism with predicted taxonomy: Collinsella
  MG14-233 HNH domain

SEQ ID NO: 4542 - protein, 163 aa, Unknown; identical to SEQ ID NO: 4352
  Description of Unknown: uncultivated organism with predicted taxonomy: Collinsella
  MG14-234 HNH domain

SEQ ID NO: 4543 - protein, 163 aa, Unknown; identical to SEQ ID NO: 4425
  Description of Unknown: uncultivated organism with predicted taxonomy: Collinsella
  MG14-235 HNH domain

SEQ ID NO: 4544 - protein, 163 aa, Unknown; identical to SEQ ID NO: 4347
  Description of Unknown: uncultivated organism with predicted taxonomy: Collinsella
  MG14-236 HNH domain

SEQ ID NO: 4545 - protein, 163 aa, Unknown; identical to SEQ ID NO: 4347
  Description of Unknown: uncultivated organism with predicted taxonomy: Collinsella
  MG14-237 HNH domain

SEQ ID NO: 4546 - protein, 171 aa, Unknown; identical to SEQ ID NO: 4417
  Description of Unknown: uncultivated organism with predicted taxonomy: Atopobium sp. ICM42b
  MG14-238 HNH domain

SEQ ID NO: 4547 - protein, 163 aa, Unknown; identical to SEQ ID NO: 4389
  Description of Unknown: uncultivated organism with predicted taxonomy: Collinsella
  MG14-239 HNH domain

SEQ ID NO: 4548 - protein, 163 aa, Unknown; identical to SEQ ID NO: 4407
  Description of Unknown: uncultivated organism with predicted taxonomy: Collinsella
  MG14-240 HNH domain

SEQ ID NO: 4549 - protein, 163 aa, Unknown; identical to SEQ ID NO: 4430
  Description of Unknown: uncultivated organism with predicted taxonomy: Collinsella
  MG14-241 HNH domain

SEQ ID NO: 4550 - protein, 163 aa, Unknown; identical to SEQ ID NO: 4388
  Description of Unknown: uncultivated organism with predicted taxonomy: Collinsella
  MG14-242 HNH domain

SEQ ID NO: 4551 - protein, 163 aa, Unknown; identical to SEQ ID NO: 4352
  Description of Unknown: uncultivated organism with predicted taxonomy: Collinsella
  MG14-243 HNH domain

SEQ ID NO: 4552 - protein, 167 aa, Unknown
  Description of Unknown: uncultivated organism
  MG14-244 HNH domain
DLKMSKREKDAVAKRQRTNEAANKKRATLAAGILGCEPSEVSHLVIRKLALREEQSDKDIYTGAAIDLQRLVEDDHYCEIGHILPYSRTGMGGWNNEVLVLAASNQKKRERTPYEWMQQDAGKAGVPAWDEYSSRVTATIDNPRKRRNLLCKDTGDEAMNGFLLRDL

SEQ ID NO: 4553 - protein, 165 aa, Unknown
  Description of Unknown: uncultivated organism with predicted taxonomy: Olsenella
  MG14-245 HNH domain
DLKMSNKEKATVSKNQRANEAANKKWAAKAANILGCSPEEVPGRIVRKLAMREEQGDKDAYTGAAIDLEHLVRDDRYCEIDHILPYSRTCDDSRANKVLVLSKSNQDKRERTPYEWMTSGEPGAPDWDEYRNRVMATVKYARKRANLLNTDLGPNVQAQFLARNL

SEQ ID NO: 4554 - protein, 166 aa, Unknown
  Description of Unknown: uncultivated organism with predicted taxonomy: Coriobacteriales
  MG14-246 HNH domain
ELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNL

SEQ ID NO: 4555 - protein, 166 aa, Unknown; identical to SEQ ID NO: 4554
  Description of Unknown: uncultivated organism with predicted taxonomy: Coriobacteriales
  MG14-247 HNH domain

SEQ ID NO: 4556 - protein, 166 aa, Unknown; identical to SEQ ID NO: 4554
  Description of Unknown: uncultivated organism
  MG14-248 HNH domain

SEQ ID NO: 4557 - protein, 166 aa, Unknown; identical to SEQ ID NO: 4554
  Description of Unknown: uncultivated organism with predicted taxonomy: Olsenella
  MG14-249 HNH domain

SEQ ID NO: 4558 - protein, 167 aa, Unknown
  Description of Unknown: uncultivated organism with predicted taxonomy: Olsenella
  MG14-250 HNH domain
ELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNL

SEQ ID NO: 4559 - protein, 167 aa, Unknown
  Description of Unknown: uncultivated organism
  MG14-251 HNH domain
NLKMSKREKDAIAKRQRSNEAANKKWAALAAGILDCEPSEVPHLVIRKLALREEQGDKDVYTGAAIDLERLVADDHYCEIDHILPYSRTGMSGWNNEVLVLAASNQKKRERTPYEWMQQDAGKSGVPAWDAYSSRVAATIGNPRKRRNLLCMDTGQEAMNGFLLRDL

SEQ ID NO: 4560 - protein, 167 aa, Unknown
  Description of Unknown: uncultivated organism with predicted taxonomy: Olsenella umbonata
  MG14-252 HNH domain
DLKRSKHEKDLISKRNRENERKNKQWRAQAAEIQGIDPDEVRPKLLKKMALWEEQGGLDAYTGHKIEFDRMISDDKYCEIDHVLPYSRTCDDSRSNKVLVLAKSNQDKRERTPYEWMTQDAQKGAPSWDEYQARVIANRHISPRKRRYLLNNNLGPDQESDFLNRNL

SEQ ID NO: 4561 - protein, 164 aa, Unknown
  Description of Unknown: uncultivated organism with predicted taxonomy: Atopobium sp. ICM42b
  MG14-253 HNH domain
DLKNSKAARDMIAKRQRDREKEKNALRKVIAELLSCELEDVTSNQLFRYELRQEQGDVDVYTGEQIDLMRMLLDQSYTQIDHILPYSRTAIDSRSNKVLVLSGSNAAKGERTPLEWMEEDVGAPDKDQYQSRIHSMSLPAAKKEKLLRRELTDADSRGFLDRNL

SEQ ID NO: 4562 - protein, 167 aa, Unknown; identical to SEQ ID NO: 4558
  Description of Unknown: uncultivated organism with predicted taxonomy: Olsenella sp. KH3B4
  MG14-254 HNH domain

SEQ ID NO: 4563 - protein, 167 aa, Unknown; identical to SEQ ID NO: 4560
  Description of Unknown: uncultivated organism with predicted taxonomy: Olsenella
  MG14-255 HNH domain

SEQ ID NO: 4564 - protein, 164 aa, Unknown
  Description of Unknown: uncultivated organism with predicted taxonomy: Olsenella
  MG14-256 HNH domain
DLKNSKAVKDKISNQQRRREAEKATLRRTIAELLQCEPDDVTGGQLLRYELRQEQNDQDVYTGDSIDLMRMLRDQSYTQIDHILPYSRTAIDSRSNKVLVLASSNAAKGERTPLEWMEQDANGPSIDAYQSRVHALNLPSAKKEKLLRRELTEDDAKHFLDRNL

SEQ ID NO: 4565 - protein, 160 aa, Unknown
  Description of Unknown: uncultivated organism with predicted taxonomy: Megasphaera
  MG15-1 HNH domain
ELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4566 - protein, 159 aa, Unknown
  Description of Unknown: uncultivated organism with predicted taxonomy: Selenomonas sp. AE3005
  MG15-3 HNH domain
EMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHL

SEQ ID NO: 4567 - protein, 159 aa, Unknown; identical to SEQ ID NO: 4566
  Description of Unknown: uncultivated organism with predicted taxonomy: Selenomonas sp. AE3005
  MG15-4 HNH domain

SEQ ID NO: 4568 - protein, 160 aa, Unknown
  Description of Unknown: uncultivated organism with predicted taxonomy: Veillonellales
  MG15-6 HNH domain
ELARSFKDRAAMDHRMKENYAKNEKIKERLSKEFHIMNPTGQDIVKWKLYEQQQGCCAYSQKPFDVDRLLHDGNYAEVDHILPYSRSFDDTYRNKVLVLEKENRDKGNRTPMEYLADKPERKEKFIAWVKTVIKDSKKREHLLRVKYGRDEEAEWKQRHL

SEQ ID NO: 4569 - protein, 160 aa, Unknown
  Description of Unknown: uncultivated organism with predicted taxonomy: Megasphaera stantonii
  MG15-7 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTATTENEWKRRNL

SEQ ID NO: 4570 - protein, 160 aa, Unknown
  Description of Unknown: uncultivated organism with predicted taxonomy: Dialister
  MG15-8 HNH domain
ELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKERFIAWVKTTIKDSKKREHLLRVKYGRDEEAEWKQRHL

SEQ ID NO: 4571 - protein, 160 aa, Unknown
  Description of Unknown: uncultivated organism with predicted taxonomy: Dialister invisus
  MG15-9 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNL

SEQ ID NO: 4572 - protein, 160 aa, Unknown
  Description of Unknown: uncultivated organism with predicted taxonomy: Dialister
  MG15-10 HNH domain
ELARNFRDRKKMEKGMQENQAKNEKIRQCLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4573 - protein, 160 aa, Unknown
  Description of Unknown: uncultivated organism with predicted taxonomy: Dialister
  MG15-11 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4574 - protein, 160 aa, Unknown
  Description of Unknown: uncultivated organism with predicted taxonomy: Megasphaera micronuciformis
  MG15-12 HNH domain
ELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHL

SEQ ID NO: 4575 - protein, 160 aa, Unknown
  Description of Unknown: uncultivated organism with predicted taxonomy: Megasphaera sp. AM44-1BH
  MG15-13 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETIENEWKRRNL

SEQ ID NO: 4576 - protein, 160 aa, Unknown
  Description of Unknown: uncultivated organism with predicted taxonomy: Dialister
  MG15-14 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4577 - protein, 160 aa, Unknown
  Description of Unknown: uncultivated organism with predicted taxonomy: Megasphaera micronuciformis
  MG15-15 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHL

SEQ ID NO: 4578 - protein, 159 aa, Unknown
  Description of Unknown: uncultivated organism with predicted taxonomy: Megasphaera stantonii
  MG15-16 HNH domain
ELAKSAKERTELEKAMKDNQSRNEKIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHL

SEQ ID NO: 4579 - protein, 160 aa, Unknown; identical to SEQ ID NO: 4573
  Description of Unknown: uncultivated organism with predicted taxonomy: Dialister
  MG15-17 HNH domain

SEQ ID NO: 4580 - protein, 160 aa, Unknown
  Description of Unknown: uncultivated organism with predicted taxonomy: Megasphaera micronuciformis
  MG15-18 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKVRHL

SEQ ID NO: 4581 - protein, 160 aa, Unknown
  Description of Unknown: uncultivated organism with predicted taxonomy: Megasphaera micronuciformis
  MG15-19 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYFSGDEARKKQFVAWVKSDIKKPRKRENLLREKFTADAENDWKIRHL

SEQ ID NO: 4582 - protein, 160 aa, Unknown; identical to SEQ ID NO: 4565
  Description of Unknown: uncultivated organism with predicted taxonomy: Dialister
  MG15-20 HNH domain

SEQ ID NO: 4583 - protein, 160 aa, Unknown; identical to SEQ ID NO: 4575
  Description of Unknown: uncultivated organism with predicted taxonomy: Dialister
  MG15-21 HNH domain

SEQ ID NO: 4584 - protein, 160 aa, Unknown
  Description of Unknown: uncultivated organism with predicted taxonomy: Dialister
  MG15-22 HNH domain
ELARSFRDRKKMEKGMQENQAKNEKIRQRLISEFGVLRPKGMDIVKSKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4585 - protein, 160 aa, Unknown
  Description of Unknown: uncultivated organism with predicted taxonomy: Dialister
  MG15-23 HNH domain
ELARNFRDRKKIEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNL

SEQ ID NO: 4586 - protein, 160 aa, Unknown
  Description of Unknown: uncultivated organism with predicted taxonomy: Dialister invisus
  MG15-24 HNH domain
ELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNL

SEQ ID NO: 4587 - protein, 160 aa, Unknown; identical to SEQ ID NO: 4586
  Description of Unknown: uncultivated organism with predicted taxonomy: Dialister
  MG15-25 HNH domain

SEQ ID NO: 4588 - protein, 160 aa, Unknown; identical to SEQ ID NO: 4565
  Description of Unknown: uncultivated organism with predicted taxonomy: Dialister
  MG15-26 HNH domain

SEQ ID NO: 4589 - protein, 160 aa, Unknown; identical to SEQ ID NO: 4573
  Description of Unknown: uncultivated organism with predicted taxonomy: Dialister
  MG15-27 HNH domain

SEQ ID NO: 4590 - protein, 160 aa, Unknown; identical to SEQ ID NO: 4565
  Description of Unknown: uncultivated organism with predicted taxonomy: Dialister
  MG15-28 HNH domain

SEQ ID NO: 4591 - protein, 160 aa, Unknown; identical to SEQ ID NO: 4565
  Description of Unknown: uncultivated organism with predicted taxonomy: Dialister invisus
  MG15-29 HNH domain

SEQ ID NO: 4592 - protein, 160 aa, Unknown; identical to SEQ ID NO: 4575
  Description of Unknown: uncultivated organism with predicted taxonomy: Megasphaera sp. AM44-1BH
  MG15-30 HNH domain

SEQ ID NO: 4593 - protein, 160 aa, Unknown
  Description of Unknown: uncultivated organism with predicted taxonomy: Dialister
  MG15-31 HNH domain
ELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKRTIRNSRKRENLLRTDYTATTENEWKRRNL

SEQ ID NO: 4594 - protein, 160 aa, Unknown; identical to SEQ ID NO: 4565
  Description of Unknown: uncultivated organism with predicted taxonomy: Veillonellales
  MG15-32 HNH domain

SEQ ID NO: 4595 - protein, 160 aa, Unknown; identical to SEQ ID NO: 4573
  Description of Unknown: uncultivated organism with predicted taxonomy: Dialister
  MG15-33 HNH domain

SEQ ID NO: 4596 - protein, 160 aa, Unknown; identical to SEQ ID NO: 4586
  Description of Unknown: uncultivated organism with predicted taxonomy: Megasphaera
  MG15-34 HNH domain

SEQ ID NO: 4597 - protein, 159 aa, Unknown
  Description of Unknown: uncultivated organism with predicted taxonomy: Megasphaera
  MG15-35 HNH domain
ELAKSAKERTELEKAMKDNQSRNEKIKTKLHELNVMQPTGLDIVKYKLYKQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHL

SEQ ID NO: 4598 - protein, 160 aa, Unknown; identical to SEQ ID NO: 4586
  Description of Unknown: uncultivated organism with predicted taxonomy: Dialister
  MG15-36 HNH domain

SEQ ID NO: 4599 - protein, 160 aa, Unknown; identical to SEQ ID NO: 4586
  Description of Unknown: uncultivated organism with predicted taxonomy: Dialister
  MG15-37 HNH domain

SEQ ID NO: 4600 - protein, 160 aa, Unknown
  Description of Unknown: uncultivated organism with predicted taxonomy: Selenomonas bovis
  MG15-38 HNH domain
EMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNL

SEQ ID NO: 4601 - protein, 160 aa, Unknown; identical to SEQ ID NO: 4565
  Description of Unknown: uncultivated organism with predicted taxonomy: Dialister
  MG15-39 HNH domain

SEQ ID NO: 4602 - protein, 160 aa, Unknown; identical to SEQ ID NO: 4565
  Description of Unknown: uncultivated organism with predicted taxonomy: Dialister
  MG15-40 HNH domain

SEQ ID NO: 4603 - protein, 160 aa, Unknown
  Description of Unknown: uncultivated organism with predicted taxonomy: Megasphaera sp. AM44-1BH
  MG15-41 HNH domain
ELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHL

SEQ ID NO: 4604 - protein, 160 aa, Unknown
  Description of Unknown: uncultivated organism with predicted taxonomy: Veillonellales
  MG15-42 HNH domain
ELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHL

SEQ ID NO: 4605 - protein, 160 aa, Unknown; identical to SEQ ID NO: 4573
  Description of Unknown: uncultivated organism with predicted taxonomy: Veillonellales
  MG15-43 HNH domain

SEQ ID NO: 4606 - protein, 160 aa, Unknown; identical to SEQ ID NO: 4604
  Description of Unknown: uncultivated organism with predicted taxonomy: Veillonellales
  MG15-44 HNH domain

SEQ ID NO: 4607 - protein, 160 aa, Unknown; identical to SEQ ID NO: 4600
  Description of Unknown: uncultivated organism with predicted taxonomy: Selenomonas bovis
  MG15-45 HNH domain

SEQ ID NO: 4608 - protein, 160 aa, Unknown
  Description of Unknown: uncultivated organism with predicted taxonomy: Dialister
  MG15-46 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNL

SEQ ID NO: 4609 - protein, 160 aa, Unknown
  Description of Unknown: uncultivated organism with predicted taxonomy: Dialister
  MG15-47 HNH domain
ELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKEKFIAWVKTTIKDSKKREHLLRVKYGRDEEAEWKQRHL

SEQ ID NO: 4610 - protein, 160 aa, Unknown; identical to SEQ ID NO: 4600
  Description of Unknown: uncultivated organism with predicted taxonomy: Selenomonas bovis
  MG15-48 HNH domain

SEQ ID NO: 4611 - protein, 160 aa, Unknown; identical to SEQ ID NO: 4586
  Description of Unknown: uncultivated organism with predicted taxonomy: Dialister
  MG15-49 HNH domain

SEQ ID NO: 4612 - protein, 160 aa, Unknown; identical to SEQ ID NO: 4565
  Description of Unknown: uncultivated organism with predicted taxonomy: Dialister
  MG15-50 HNH domain

SEQ ID NO: 4613 - protein, 160 aa, Unknown; identical to SEQ ID NO: 4573
  Description of Unknown: uncultivated organism with predicted taxonomy: Dialister
  MG15-51 HNH domain

SEQ ID NO: 4614 - protein, 160 aa, Unknown; identical to SEQ ID NO: 4586
  Description of Unknown: uncultivated organism with predicted taxonomy: Veillonellales
  MG15-52 HNH domain

SEQ ID NO: 4615 - protein, 160 aa, Unknown; identical to SEQ ID NO: 4586
  Description of Unknown: uncultivated organism with predicted taxonomy: Dialister invisus
  MG15-53 HNH domain

SEQ ID NO: 4616 - protein, 160 aa, Unknown; identical to SEQ ID NO: 4573
  Description of Unknown: uncultivated organism with predicted taxonomy: Dialister
  MG15-54 HNH domain

SEQ ID NO: 4617 - protein, 160 aa, Unknown
  Description of Unknown: uncultivated organism with predicted taxonomy: Megasphaera stantonii
  MG15-55 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDVKKPRKRENLLREKFTADAENDWKVRHL

SEQ ID NO: 4618 - protein, 160 aa, Unknown; identical to SEQ ID NO: 4600
  Description of Unknown: uncultivated organism with predicted taxonomy: Selenomonas bovis
  MG15-56 HNH domain

SEQ ID NO: 4619 - protein, 160 aa, Unknown; identical to SEQ ID NO: 4573
  Description of Unknown: uncultivated organism with predicted taxonomy: Dialister
  MG15-57 HNH domain

SEQ ID NO: 4620 - protein, 160 aa, Unknown; identical to SEQ ID NO: 4608
  Description of Unknown: uncultivated organism with predicted taxonomy: Dialister
  MG15-58 HNH domain

SEQ ID NO: 4621 - protein, 160 aa, Unknown; identical to SEQ ID NO: 4608
  Description of Unknown: uncultivated organism with predicted taxonomy: Dialister
  MG15-59 HNH domain

SEQ ID NO: 4622 - protein, 160 aa, Unknown; identical to SEQ ID NO: 4586
  Description of Unknown: uncultivated organism with predicted taxonomy: Megasphaera
  MG15-60 HNH domain

SEQ ID NO: 4623 - protein, 160 aa, Unknown; identical to SEQ ID NO: 4586
  Description of Unknown: uncultivated organism with predicted taxonomy: Dialister
  MG15-61 HNH domain

SEQ ID NO: 4624 - protein, 160 aa, Unknown; identical to SEQ ID NO: 4580
  Description of Unknown: uncultivated organism with predicted taxonomy: Megasphaera stantonii
  MG15-62 HNH domain

SEQ ID NO: 4625 - protein, 160 aa, Unknown
  Description of Unknown: uncultivated organism with predicted taxonomy: Dialister
  MG15-63 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRLIHWVKSTIRNSRKRENLLRIDYTETTENEWKRRNL

SEQ ID NO: 4626 - protein, 160 aa, Unknown; identical to SEQ ID NO: 4608
  Description of Unknown: uncultivated organism with predicted taxonomy: Megasphaera
  MG15-64 HNH domain

SEQ ID NO: 4627 - protein, 160 aa, Unknown; identical to SEQ ID NO: 4565
  Description of Unknown: uncultivated organism with predicted taxonomy: Dialister
  MG15-65 HNH domain

SEQ ID NO: 4628 - protein, 160 aa, Unknown; identical to SEQ ID NO: 4577
  Description of Unknown: uncultivated organism with predicted taxonomy: Megasphaera micronuciformis
  MG15-66 HNH domain

SEQ ID NO: 4629 - protein, 160 aa, Unknown
  Description of Unknown: uncultivated organism with predicted taxonomy: Megasphaera stantonii
  MG15-67 HNH domain
ELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHL

SEQ ID NO: 4630 - protein, 159 aa, Unknown
  Description of Unknown: uncultivated organism with predicted taxonomy: Veillonellaceae bacterium DNF00626
  MG15-68 HNH domain
DLGRNFKDRDLIKSNMEKNQKKNDEIKERIVNEFGIMQPKSQDIVKLKLCEQQDNVCVYSQKSFDLHRLFEKNYVEVDHIIPYSRSFDDTYANKVLVFNKENRDKGNKLPLEYLANQPERKEKFIAWVKSHIKDRKKRDNLLRESYSAEDKNGWKQRNL

SEQ ID NO: 4631 - protein, 160 aa, Unknown
  Description of Unknown: uncultivated organism with predicted taxonomy: Dialister
  MG15-69 HNH domain
ELARSFKDRAAMDDRMKENHAKNEEIKEYLSKELHVMSPTGQDIVKWKLYKQQQGYCAYSQKLFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHL

SEQ ID NO: 4632 - protein, 160 aa, Unknown; identical to SEQ ID NO: 4573
  Description of Unknown: uncultivated organism with predicted taxonomy: Dialister
  MG15-70 HNH domain

SEQ ID NO: 4633 - protein, 160 aa, Unknown; identical to SEQ ID NO: 4608
  Description of Unknown: uncultivated organism with predicted taxonomy: Dialister
  MG15-71 HNH domain

SEQ ID NO: 4634 - protein, 160 aa, Unknown; identical to SEQ ID NO: 4585
  Description of Unknown: uncultivated organism with predicted taxonomy: Dialister
  MG15-72 HNH domain

SEQ ID NO: 4635 - protein, 160 aa, Unknown; identical to SEQ ID NO: 4586
  Description of Unknown: uncultivated organism with predicted taxonomy: Dialister invisus
  MG15-73 HNH domain

SEQ ID NO: 4636 - protein, 160 aa, Unknown; identical to SEQ ID NO: 4586
  Description of Unknown: uncultivated organism with predicted taxonomy: Dialister
  MG15-74 HNH domain

SEQ ID NO: 4637 - protein, 160 aa, Unknown; identical to SEQ ID NO: 4586
  Description of Unknown: uncultivated organism with predicted taxonomy: Dialister invisus
  MG15-75 HNH domain

SEQ ID NO: 4638 - protein, 160 aa, Unknown; identical to SEQ ID NO: 4565
  Description of Unknown: uncultivated organism with predicted taxonomy: Dialister
  MG15-76 HNH domain

SEQ ID NO: 4639 - protein, 160 aa, Unknown; identical to SEQ ID NO: 4573
  Description of Unknown: uncultivated organism with predicted taxonomy: Dialister invisus
  MG15-77 HNH domain

SEQ ID NO: 4640 - protein, 160 aa, Unknown; identical to SEQ ID NO: 4586
  Description of Unknown: uncultivated organism with predicted taxonomy: Dialister
  MG15-78 HNH domain

SEQ ID NO: 4641 - protein, 160 aa, Unknown; identical to SEQ ID NO: 4565
  Description of Unknown: uncultivated organism with predicted taxonomy: Megasphaera stantonii
  MG15-79 HNH domain

SEQ ID NO: 4642 - protein, 160 aa, Unknown; identical to SEQ ID NO: 4575
  Description of Unknown: uncultivated organism with predicted taxonomy: Megasphaera sp. AM44-1BH
  MG15-80 HNH domain

SEQ ID NO: 4643 - protein, 160 aa, Unknown; identical to SEQ ID NO: 4565
  Description of Unknown: uncultivated organism with predicted taxonomy: Megasphaera
  MG15-81 HNH domain

SEQ ID NO: 4644 - protein, 160 aa, Unknown; identical to SEQ ID NO: 4575
  Description of Unknown: uncultivated organism with predicted taxonomy: Megasphaera sp. AM44-1BH
  MG15-82 HNH domain

SEQ ID NO: 4645 - protein, 159 aa, Unknown; identical to SEQ ID NO: 4630
  Description of Unknown: uncultivated organism with predicted taxonomy: Veillonellaceae bacterium DNF00626
  MG15-83 HNH domain

SEQ ID NO: 4646 - protein, 160 aa, Unknown; identical to SEQ ID NO: 4575
  Description of Unknown: uncultivated organism with predicted taxonomy: Dialister
  MG15-84 HNH domain

SEQ ID NO: 4647 - protein, 160 aa, Unknown; identical to SEQ ID NO: 4575
  Description of Unknown: uncultivated organism with predicted taxonomy: Dialister
  MG15-85 HNH domain

SEQ ID NO: 4648 - protein, 160 aa, Unknown; identical to SEQ ID NO: 4573
  Description of Unknown: uncultivated organism with predicted taxonomy: Dialister
  MG15-86 HNH domain

SEQ ID NO: 4649 - protein, 160 aa, Unknown; identical to SEQ ID NO: 4593
  Description of Unknown: uncultivated organism with predicted taxonomy: Dialister
  MG15-87 HNH domain

SEQ ID NO: 4650 - protein, 160 aa, Unknown
  Description of Unknown: uncultivated organism with predicted taxonomy: Megasphaera sp. AM44-1BH
  MG15-88 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENRKKRNRIPMEYLADATERKNRFIHWVKSTIRNSRKRENLLRTDYTETTENEWKRRNL

SEQ ID NO: 4651 - protein, 160 aa, Unknown; identical to SEQ ID NO: 4573
  Description of Unknown: uncultivated organism with predicted taxonomy: Dialister
  MG15-89 HNH domain

SEQ ID NO: 4652 - protein, 160 aa, Unknown; identical to SEQ ID NO: 4576
  Description of Unknown: uncultivated organism with predicted taxonomy: Dialister
  MG15-90 HNH domain

SEQ ID NO: 4653 - protein, 160 aa, Unknown; identical to SEQ ID NO: 4608
  Description of Unknown: uncultivated organism with predicted taxonomy: Dialister
  MG15-91 HNH domain

SEQ ID NO: 4654 - protein, 159 aa, Unknown; identical to SEQ ID NO: 4578
  Description of Unknown: uncultivated organism with predicted taxonomy: Firmicutes
  MG15-92 HNH domain

SEQ ID NO: 4655 - protein, 160 aa, Unknown
  Description of Unknown: uncultivated organism with predicted taxonomy: Megasphaera micronuciformis
  MG15-93 HNH domain
ELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHL

SEQ ID NO: 4656 - protein, 160 aa, Unknown; identical to SEQ ID NO: 4586
  Description of Unknown: uncultivated organism with predicted taxonomy: Dialister
  MG15-94 HNH domain

SEQ ID NO: 4657 - protein, 160 aa, Unknown; identical to SEQ ID NO: 4586
  Description of Unknown: uncultivated organism with predicted taxonomy: Dialister
  MG15-95 HNH domain

SEQ ID NO: 4658 - protein, 160 aa, Unknown
  Description of Unknown: uncultivated organism with predicted taxonomy: Megasphaera micronuciformis
  MG15-96 HNH domain
ELAKSFDERQKMTKSIEENQSHNERIKERLQKEFNVPYPSGQDIVKLKLYEEQNEICAYSQKHIDAAKLFHDPNYAEVDHIIPYSRSFDDTYNNKVLVLTAENRQKGNRTPMEYLSGDEARKKQFVAWVKSDIKKPRKRENLLREKFTTDAENDWKARHL

SEQ ID NO: 4659 - protein, 160 aa, Unknown; identical to SEQ ID NO: 4581
  Description of Unknown: uncultivated organism with predicted taxonomy: Megasphaera micronuciformis
  MG15-97 HNH domain

SEQ ID NO: 4660 - protein, 160 aa, Unknown; identical to SEQ ID NO: 4565
  Description of Unknown: uncultivated organism with predicted taxonomy: Dialister
  MG15-98 HNH domain

SEQ ID NO: 4661 - protein, 160 aa, Unknown; identical to SEQ ID NO: 4577
  Description of Unknown: uncultivated organism with predicted taxonomy: Megasphaera micronuciformis
  MG15-99 HNH domain

SEQ ID NO: 4662 - protein, 160 aa, Unknown; identical to SEQ ID NO: 4580
  Description of Unknown: uncultivated organism with predicted taxonomy: Megasphaera stantonii
  MG15-100 HNH domain

SEQ ID NO: 4663 - protein, 160 aa, Unknown; identical to SEQ ID NO: 4586
  Description of Unknown: uncultivated organism with predicted taxonomy: Dialister
  MG15-101 HNH domain

SEQ ID NO: 4664 - protein, 160 aa, Unknown; identical to SEQ ID NO: 4565
  Description of Unknown: uncultivated organism with predicted taxonomy: Megasphaera
  MG15-102 HNH domain

SEQ ID NO: 4665 - protein, 160 aa, Unknown; identical to SEQ ID NO: 4603
  Description of Unknown: uncultivated organism with predicted taxonomy: Megasphaera sp. AM44-1BH
  MG15-103 HNH domain

SEQ ID NO: 4666 - protein, 160 aa, Unknown
  Description of Unknown: uncultivated organism with predicted taxonomy: Dialister
  MG15-104 HNH domain
ELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4667 - protein, 160 aa, Unknown; identical to SEQ ID NO: 4577
  Description of Unknown: uncultivated organism with predicted taxonomy: Megasphaera micronuciformis
  MG15-105 HNH domain

SEQ ID NO: 4668 - protein, 160 aa, Unknown; identical to SEQ ID NO: 4584
  Description of Unknown: uncultivated organism with predicted taxonomy: Dialister
  MG15-106 HNH domain

SEQ ID NO: 4669 - protein, 160 aa, Unknown; identical to SEQ ID NO: 4565
  Description of Unknown: uncultivated organism with predicted taxonomy: Dialister
  MG15-107 HNH domain

SEQ ID NO: 4670 - protein, 160 aa, Unknown; identical to SEQ ID NO: 4565
  Description of Unknown: uncultivated organism with predicted taxonomy: Dialister
  MG15-108 HNH domain

SEQ ID NO: 4671 - protein, 160 aa, Unknown; identical to SEQ ID NO: 4629
  Description of Unknown: uncultivated organism with predicted taxonomy: Megasphaera stantonii
  MG15-109 HNH domain

SEQ ID NO: 4672 - protein, 160 aa, Unknown; identical to SEQ ID NO: 4625
  Description of Unknown: uncultivated organism with predicted taxonomy: Dialister
  MG15-110 HNH domain

SEQ ID NO: 4673 - protein, 160 aa, Unknown; identical to SEQ ID NO: 4565
  Description of Unknown: uncultivated organism with predicted taxonomy: Veillonellales
  MG15-111 HNH domain

SEQ ID NO: 4674 - protein, 160 aa, Unknown; identical to SEQ ID NO: 4586
  Description of Unknown: uncultivated organism with predicted taxonomy: Dialister
  MG15-112 HNH domain

SEQ ID NO: 4675 - protein, 160 aa, Unknown; identical to SEQ ID NO: 4565
  Description of Unknown: uncultivated organism with predicted taxonomy: Dialister
  MG15-113 HNH domain

SEQ ID NO: 4676 - protein, 160 aa, Unknown
  Description of Unknown: uncultivated organism with predicted taxonomy: Veillonellales
  MG15-114 HNH domain
ELARSFKDRAAMDDRMKENHAKNEEIKEYLSKELHVMSPTGQDIVKWKLYKQQQGYCAYSQKPFDVNKLLHDRTYAEVDHILPYSRSFDDTYRNKVLVLTKENRDKGNRTPMEYLADKPERKGKFIAWVKTTIKDSKKREHLLRVKYGRDEEAEWKQRHL

SEQ ID NO: 4677 - protein, 160 aa, Unknown; identical to SEQ ID NO: 4565
  Description of Unknown: uncultivated organism with predicted taxonomy: Dialister
  MG15-115 HNH domain

SEQ ID NO: 4678 - protein, 160 aa, Unknown; identical to SEQ ID NO: 4575
  Description of Unknown: uncultivated organism with predicted taxonomy: Megasphaera sp. AM44-1BH
  MG15-116 HNH domain

SEQ ID NO: 4679 - protein, 159 aa, Unknown; identical to SEQ ID NO: 4597
  Description of Unknown: uncultivated organism with predicted taxonomy: Megasphaera
  MG15-117 HNH domain

SEQ ID NO: 4680 - protein, 160 aa, Unknown; identical to SEQ ID NO: 4573
  Description of Unknown: uncultivated organism with predicted taxonomy: Dialister
  MG15-118 HNH domain

SEQ ID NO: 4681 - protein, 160 aa, Unknown; identical to SEQ ID NO: 4609
  Description of Unknown: uncultivated organism with predicted taxonomy: Dialister
  MG15-119 HNH domain

SEQ ID NO: 4682 - protein, 160 aa, Unknown
  Description of Unknown: uncultivated organism with predicted taxonomy: Megasphaera micronuciformis
  MG15-120 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLNGDEARKKQFVAWVKSDIKKPRKRENLLREKFTDDVENDWKERHL

SEQ ID NO: 4683 - protein, 160 aa, Unknown; identical to SEQ ID NO: 4577
  Description of Unknown: uncultivated organism with predicted taxonomy: Megasphaera micronuciformis
  MG15-121 HNH domain

SEQ ID NO: 4684 - protein, 160 aa, Unknown; identical to SEQ ID NO: 4586
  Description of Unknown: uncultivated organism with predicted taxonomy: Dialister invisus
  MG15-122 HNH domain

SEQ ID NO: 4685 - protein, 160 aa, Unknown; identical to SEQ ID NO: 4573
  Description of Unknown: uncultivated organism with predicted taxonomy: Megasphaera
  MG15-123 HNH domain

SEQ ID NO: 4686 - protein, 160 aa, Unknown
  Description of Unknown: uncultivated organism with predicted taxonomy: Dialister
  MG15-124 HNH domain
ELARNFRDRKKMEKGMQENQAKNEKIRQRLISEFGVLRPKGMDIVKFRLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4687 - protein, 160 aa, Unknown; identical to SEQ ID NO: 4573
  Description of Unknown: uncultivated organism with predicted taxonomy: Dialister
  MG15-125 HNH domain

SEQ ID NO: 4688 - protein, 160 aa, Unknown
  Description of Unknown: uncultivated organism with predicted taxonomy: Megasphaera stantonii
  MG15-126 HNH domain
ELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKQRKRENLLREKFTADAENDWKARHL

SEQ ID NO: 4689 - protein, 160 aa, Unknown; identical to SEQ ID NO: 4608
  Description of Unknown: uncultivated organism with predicted taxonomy: Dialister
  MG15-127 HNH domain

SEQ ID NO: 4690 - protein, 160 aa, Unknown; identical to SEQ ID NO: 4608
  Description of Unknown: uncultivated organism with predicted taxonomy: Dialister invisus
  MG15-128 HNH domain

SEQ ID NO: 4691 - protein, 160 aa, Unknown; identical to SEQ ID NO: 4608
  Description of Unknown: uncultivated organism with predicted taxonomy: Dialister
  MG15-129 HNH domain

SEQ ID NO: 4692 - protein, 160 aa, Unknown; identical to SEQ ID NO: 4575
  Description of Unknown: uncultivated organism with predicted taxonomy: Dialister
  MG15-130 HNH domain

SEQ ID NO: 4693 - protein, 160 aa, Unknown; identical to SEQ ID NO: 4586
  Description of Unknown: uncultivated organism with predicted taxonomy: Dialister
  MG15-131 HNH domain

SEQ ID NO: 4694 - protein, 160 aa, Unknown; identical to SEQ ID NO: 4604
  Description of Unknown: uncultivated organism with predicted taxonomy: Veillonella magna
  MG15-132 HNH domain

SEQ ID NO: 4695 - protein, 160 aa, Unknown; identical to SEQ ID NO: 4565
  Description of Unknown: uncultivated organism with predicted taxonomy: Dialister
  MG15-133 HNH domain

SEQ ID NO: 4696 - protein, 160 aa, Unknown; identical to SEQ ID NO: 4577
  Description of Unknown: uncultivated organism with predicted taxonomy: Megasphaera micronuciformis
  MG15-134 HNH domain

SEQ ID NO: 4697 - protein, 160 aa, Unknown; identical to SEQ ID NO: 4580
  Description of Unknown: uncultivated organism with predicted taxonomy: Megasphaera micronuciformis
  MG15-135 HNH domain

SEQ ID NO: 4698 - protein, 160 aa, Unknown; identical to SEQ ID NO: 4586
  Description of Unknown: uncultivated organism with predicted taxonomy: Megasphaera stantonii
  MG15-136 HNH domain

SEQ ID NO: 4699 - protein, 160 aa, Unknown; identical to SEQ ID NO: 4603
  Description of Unknown: uncultivated organism with predicted taxonomy: Megasphaera sp. AM44-1BH
  MG15-137 HNH domain

SEQ ID NO: 4700 - protein, 159 aa, Unknown
  Description of Unknown: uncultivated organism with predicted taxonomy: Megasphaera
  MG15-138 HNH domain
ELAKNAKERTELEKAMKDNQSRNEEIKTKLHELNVMQPTGLDIVKYKLYEQQQGDCAYSQKKFDVDRLLHDSTYAEVDHIIPYSRSFDDTYRNKVLVLTKENRDKGNRTPMEYFQDKPERKEAFVRWVKRTISDGKKRNNLLRVNYSADAEKEWKDRHL

SEQ ID NO: 4701 - protein, 159 aa, Unknown
  Description of Unknown: uncultivated organism with predicted taxonomy: Megasphaera
  MG15-139 HNH domain
ELAKSAKERTELEKAMKDNQSRNEEIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHL

SEQ ID NO: 4702 - protein, 160 aa, Unknown; identical to SEQ ID NO: 4603
  Description of Unknown: uncultivated organism with predicted taxonomy: Megasphaera sp. AM44-1BH
  MG15-140 HNH domain

SEQ ID NO: 4703 - protein, 160 aa, Unknown; identical to SEQ ID NO: 4608
  Description of Unknown: uncultivated organism with predicted taxonomy: Dialister
  MG15-141 HNH domain

SEQ ID NO: 4704 - protein, 160 aa, Unknown; identical to SEQ ID NO: 4603
  Description of Unknown: uncultivated organism with predicted taxonomy: Megasphaera sp. AM44-1BH
  MG15-142 HNH domain

SEQ ID NO: 4705 - protein, 160 aa, Unknown; identical to SEQ ID NO: 4574
  Description of Unknown: uncultivated organism with predicted taxonomy: Megasphaera micronuciformis
  MG15-143 HNH domain

SEQ ID NO: 4706 - protein, 160 aa, Unknown; identical to SEQ ID NO: 4655
  Description of Unknown: uncultivated organism with predicted taxonomy: Megasphaera stantonii
  MG15-144 HNH domain

SEQ ID NO: 4707 - protein, 160 aa, Unknown; identical to SEQ ID NO: 4577
  Description of Unknown: uncultivated organism with predicted taxonomy: Megasphaera stantonii
  MG15-145 HNH domain

SEQ ID NO: 4708 - protein, 160 aa, Unknown
  Description of Unknown: uncultivated organism with predicted taxonomy: Megasphaera stantonii
  MG15-146 HNH domain
EMGRSFQERRDMMKSMEDNNAANEKLKEEIKKDYGIAHPNGLDIVKYKLFKEQGERCAYSLKPMDARQVLKDPSYAEVDHILPYSRSFDDSYANKVLVLAKENRDKGNRTPMEYMANLPERKHAFITWVKSNVRNPKKRDNLLLEKFDGDKEDAWKERHL

SEQ ID NO: 4709 - protein, 158 aa, Unknown
  Description of Unknown: uncultivated organism with predicted taxonomy: Selenomonas ruminantium
  MG15-147 HNH domain
EMARSKKDRDAMTTSMEKNRAENETIKRELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHL

SEQ ID NO: 4710 - protein, 158 aa, Unknown
  Description of Unknown: uncultivated organism with predicted taxonomy: Selenomonas sp. AE3005
  MG15-148 HNH domain
EMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHL

SEQ ID NO: 4711 - protein, 158 aa, Unknown
  Description of Unknown: uncultivated organism with predicted taxonomy: Selenomonas ruminantium
  MG15-149 HNH domain
EMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHL

SEQ ID NO: 4712 - protein, 159 aa, Unknown
  Description of Unknown: uncultivated organism with predicted taxonomy: Selenomonas ruminantium
  MG15-150 HNH domain
EMGRTFQERREMMKSMEDNNTKNEKLKEELKDYGVAHPSGLDIVKLKLYKEQGGVCAYSLAAMPIEKVLNDYDYAEVDHILPYSRSFDDSYANKVLVLAKENRDKGNRTPMEYMEKTPGKKHDFVTWVKASVRNPKKRDNLLLEKFDEDKEAAWKERHL

SEQ ID NO: 4713 - protein, 158 aa, Unknown
  Description of Unknown: uncultivated organism with predicted taxonomy: Selenomonas sp. AE3005
  MG15-151 HNH domain
EMARNFQDRRDMRHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHL

SEQ ID NO: 4714 - protein, 162 aa, Unknown
  Description of Unknown: uncultivated organism with predicted taxonomy: Selenomonas sp. AE3005
  MG15-152 HNH domain
EMARSFQDRKDMHNKMENNRKANEQIIKELRENGLLQPNGLDIVKWKLYKEQQGVCAYSQKTFDVERLLHDGKYDGKYAEVDHILPYSRSFDDSYTNKVLVMAGENQHKGNRTPWEYMRDNEEKWTSFACWTNTAIRDFRKRQNLLRKNFCSEEKEWKERHL

SEQ ID NO: 4715 - protein, 158 aa, Unknown
  Description of Unknown: uncultivated organism with predicted taxonomy: Selenomonas sp. AE3005
  MG15-153 HNH domain
EMARSFQDRRDMHNKMENNRKANEQIIKELRENGLLQPNGLDIVKWKLYKEQQGICAYSQKTFDVERLLHDGKYAEVDHILPYSRSFDDSYTNKVLVMAGENQHKGNRTPWEYMRDNEEKWTSFACWTNTAIRDFRKRQNLLRKNFCSEEKEWKERHL

SEQ ID NO: 4716 - protein, 158 aa, Unknown; identical to SEQ ID NO: 4711
  Description of Unknown: uncultivated organism with predicted taxonomy: Selenomonas ruminantium
  MG15-154 HNH domain

SEQ ID NO: 4717 - protein, 158 aa, Unknown
  Description of Unknown: uncultivated organism with predicted taxonomy: Selenomonas sp. AE3005
  MG15-155 HNH domain
EMARSFQDRKDMHNKMENNRKANEQIIKELRENGLLQPNGLDIVKWKLYKEQQGVCAYSQKTFDVERLLHDGKYAEVDHILPYSRSFDDSYTNKVLVMAGENQHKGNRTPWEYMSNNEEKWTAFACWTNTAIRDFRKRQNLLRKKFCSEEKEWKERHL

SEQ ID NO: 4718 - protein, 158 aa, Unknown
  Description of Unknown: uncultivated organism with predicted taxonomy: Selenomonas sp. AE3005
  MG15-156 HNH domain
EMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKQNAFVCWANTSIRDLRKRQNLLRKNFHSEEKEWKDRHL

SEQ ID NO: 4719 - protein, 159 aa, Unknown
  Description of Unknown: uncultivated organism with predicted taxonomy: Megasphaera stantonii
  MG15-157 HNH domain
EMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHL

SEQ ID NO: 4720 - protein, 158 aa, Unknown; identical to SEQ ID NO: 4711
  Description of Unknown: uncultivated organism with predicted taxonomy: Selenomonas ruminantium
  MG15-158 HNH domain

SEQ ID NO: 4721 - protein, 158 aa, Unknown; identical to SEQ ID NO: 4711
  Description of Unknown: uncultivated organism with predicted taxonomy: Selenomonas ruminantium
  MG15-159 HNH domain

SEQ ID NO: 4722 - protein, 159 aa, Unknown; identical to SEQ ID NO: 4719
  Description of Unknown: uncultivated organism with predicted taxonomy: Megasphaera stantonii
  MG15-160 HNH domain

SEQ ID NO: 4723 - protein, 160 aa, Unknown; identical to SEQ ID NO: 4600
  Description of Unknown: uncultivated organism with predicted taxonomy: Selenomonas sp. AE3005
  MG15-161 HNH domain

SEQ ID NO: 4724 - protein, 160 aa, Unknown
  Description of Unknown: uncultivated organism with predicted taxonomy: Megasphaera
  MG15-162 HNH domain
ELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRIDYTETTENEWKRRNL

SEQ ID NO: 4725 - protein, 160 aa, Unknown
  Description of Unknown: uncultivated organism with predicted taxonomy: Megasphaera stantonii
  MG15-163 HNH domain
ELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIWNSRKRENLLRIDYTETTENEWKRRNL

SEQ ID NO: 4726 - protein, 160 aa, Unknown
  Description of Unknown: uncultivated organism with predicted taxonomy: Megasphaera
  MG15-164 HNH domain
ELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRTDYTATTENEWKRRNL

SEQ ID NO: 4727 - protein, 160 aa, Unknown; identical to SEQ ID NO: 4565
  Description of Unknown: uncultivated organism with predicted taxonomy: Megasphaera stantonii
  MG15-165 HNH domain

SEQ ID NO: 4728 - protein, 160 aa, Unknown
  Description of Unknown: uncultivated organism with predicted taxonomy: Bacteroidales
  MG16-2 HNH domain
ELKQSREERELTDKNNRNRQKENDSNAKLIEEYGIRASRNRIQKYRMWKESRQTCFYCGQVVDVKDFLRGYDVEVEHIIPKALFFDDSFSNKVCSCRKCNSEKGERTAYDYMSSKGEDELNRYIRTVEDRCKKGEISKTKRERLLTPADKIPTDFINRQL

SEQ ID NO: 4729 - protein, 160 aa, Unknown
  Description of Unknown: uncultivated organism with predicted taxonomy: Bacteroidales
  MG16-5 HNH domain
ELKSSKDEREAAFKRNNENERQNKIYENRIREYGIQPSRSRIQKYKMWEESNHLCFYCGKPVNVTDFLAGAEVEIEHIIPQSVLFDDSYSNKVCACRACNQAKGNLTAREFMEKHSKEEYDSYLRRVDDAFNAHRISKTKRDHLLWRKEDIPQDFIDRQL

SEQ ID NO: 4730 - protein, 160 aa, Unknown; identical to SEQ ID NO: 4729
  Description of Unknown: uncultivated organism with predicted taxonomy: Bacteroidetes
  MG16-6 HNH domain

SEQ ID NO: 4731 - protein, 160 aa, Unknown
  Description of Unknown: uncultivated organism with predicted taxonomy: Bacteroides
  MG16-7 HNH domain
ELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQL

SEQ ID NO: 4732 - protein, 160 aa, Unknown; identical to SEQ ID NO: 4731
  Description of Unknown: uncultivated organism with predicted taxonomy: Bacteroides
  MG16-8 HNH domain

SEQ ID NO: 4733 - protein, 160 aa, Unknown; identical to SEQ ID NO: 4731
  Description of Unknown: uncultivated organism with predicted taxonomy: Bacteroides sp. CAG:770
  MG16-9 HNH domain

SEQ ID NO: 4734 - protein, 160 aa, Unknown; identical to SEQ ID NO: 4731
  Description of Unknown: uncultivated organism with predicted taxonomy: Bacteroides
  MG16-10 HNH domain

SEQ ID NO: 4735 - protein, 160 aa, Unknown; identical to SEQ ID NO: 4731
  Description of Unknown: uncultivated organism with predicted taxonomy: Bacteroides
  MG16-11 HNH domain

SEQ ID NO: 4736 - protein, 160 aa, Unknown; identical to SEQ ID NO: 4729
  Description of Unknown: uncultivated organism with predicted taxonomy: Bacteroidetes
  MG16-12 HNH domain

SEQ ID NO: 4737 - protein, 160 aa, Unknown; identical to SEQ ID NO: 4731
  Description of Unknown: uncultivated organism with predicted taxonomy: Bacteroides
  MG16-13 HNH domain

SEQ ID NO: 4738 - protein, 160 aa, Unknown; identical to SEQ ID NO: 4731
  Description of Unknown: uncultivated organism with predicted taxonomy: Bacteroides sp. CAG:770
  MG16-14 HNH domain

SEQ ID NO: 4739 - protein, 160 aa, Unknown
  Description of Unknown: uncultivated organism with predicted taxonomy: Bacteroides sp. CAG:770
  MG16-15 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPTDKLPKDFISRQL

SEQ ID NO: 4740 - protein, 160 aa, Unknown
  Description of Unknown: uncultivated organism with predicted taxonomy: Bacteroides sp. CAG:709
  MG16-16 HNH domain
ELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4741 - protein, 160 aa, Unknown
  Description of Unknown: uncultivated organism with predicted taxonomy: Bacteroides sp. CAG:770
  MG16-17 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4742 - protein, 160 aa, Unknown
  Description of Unknown: uncultivated organism with predicted taxonomy: Bacteroides sp. CAG:770
  MG16-18 HNH domain
ELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQL

SEQ ID NO: 4743 - protein, 160 aa, Unknown
  Description of Unknown: uncultivated organism with predicted taxonomy: Bacteroides sp. CAG:770
  MG16-19 HNH domain
ELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENTISQTKRNRLLTPADKIPKDFIARQL

SEQ ID NO: 4744 - protein, 160 aa, Unknown
  Description of Unknown: uncultivated organism with predicted taxonomy: Bacteroides sp. CAG:770
  MG16-20 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQL

SEQ ID NO: 4745 - protein, 160 aa, Unknown
  Description of Unknown: uncultivated organism with predicted taxonomy: Bacteroides sp. CAG:770
  MG16-21 HNH domain
ELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4746 - protein, 160 aa, Unknown
  Description of Unknown: uncultivated organism with predicted taxonomy: Bacteroides sp. CAG:770
  MG16-22 HNH domain
ELKLSKSGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4747 - protein, 160 aa, Unknown
  Description of Unknown: uncultivated organism with predicted taxonomy: Bacteroidales
  MG16-23 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQL

SEQ ID NO: 4748 - protein, 160 aa, Unknown; identical to SEQ ID NO: 4741
  Description of Unknown: uncultivated organism with predicted taxonomy: Bacteroides sp. CAG:770
  MG16-24 HNH domain

SEQ ID NO: 4749 - protein, 160 aa, Unknown
  Description of Unknown: uncultivated organism with predicted taxonomy: Bacteroides sp. CAG:770
  MG16-25 HNH domain
ELKLSKEGRESAAKNIRAREKANEEIARRIEELGLVPSKNKILKYRLWEESVKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQL

SEQ ID NO: 4750 - protein, 160 aa, Unknown; identical to SEQ ID NO: 4741
  Description of Unknown: uncultivated organism with predicted taxonomy: Bacteroides
  MG16-26 HNH domain

SEQ ID NO: 4751 - protein, 160 aa, Unknown
  Description of Unknown: uncultivated organism with predicted taxonomy: Bacteroides sp. CAG:770
  MG16-27 HNH domain
ELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKGNATAFDYMKGRGENAFEDYLKRVEAAFKENKISQTKRNRLLTPADKIPKDFISRQL

SEQ ID NO: 4752 - protein, 160 aa, Unknown; identical to SEQ ID NO: 4741
  Description of Unknown: uncultivated organism with predicted taxonomy: Bacteroides sp. CAG:545
  MG16-28 HNH domain

SEQ ID NO: 4753 - protein, 160 aa, Unknown
  Description of Unknown: uncultivated organism with predicted taxonomy: Bacteroides sp. CAG:709
  MG16-29 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRKSTAYDYMKSKGENAFNDYLRRVDTAFSEHKISFTKRSRLLTPADKIPKDFISRQL

SEQ ID NO: 4754 - protein, 160 aa, Unknown
  Description of Unknown: uncultivated organism with predicted taxonomy: Bacteroides sp. CAG:709
  MG16-30 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4755 - protein, 160 aa, Unknown; identical to SEQ ID NO: 4754
  Description of Unknown: uncultivated organism with predicted taxonomy: Bacteroides sp. CAG:709
  MG16-31 HNH domain

SEQ ID NO: 4756 - protein, 160 aa, Unknown
  Description of Unknown: uncultivated organism with predicted taxonomy: Alistipes sp. CAG:514
  MG16-32 HNH domain
ELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQL

SEQ ID NO: 4757 - protein, 160 aa, Unknown; identical to SEQ ID NO: 4756
  Description of Unknown: uncultivated organism with predicted taxonomy: Alistipes sp. CAG:514
  MG16-33 HNH domain

SEQ ID NO: 4758 - protein, 160 aa, Unknown; identical to SEQ ID NO: 4741
  Description of Unknown: uncultivated organism with predicted taxonomy: Bacteroides sp. CAG:545
  MG16-34 HNH domain

SEQ ID NO: 4759 - protein, 160 aa, Unknown; identical to SEQ ID NO: 4742
  Description of Unknown: uncultivated organism with predicted taxonomy: Bacteroides sp. CAG:770
  MG16-35 HNH domain

SEQ ID NO: 4760 - protein, 160 aa, Unknown; identical to SEQ ID NO: 4741
  Description of Unknown: uncultivated organism with predicted taxonomy: Bacteroides
  MG16-36 HNH domain

SEQ ID NO: 4761 - protein, 160 aa, Unknown; identical to SEQ ID NO: 4741
  Description of Unknown: uncultivated organism with predicted taxonomy: Bacteroides sp. CAG:545
  MG16-37 HNH domain

SEQ ID NO: 4762 - protein, 160 aa, Unknown; identical to SEQ ID NO: 4741
  Description of Unknown: uncultivated organism with predicted taxonomy: Bacteroides
  MG16-38 HNH domain

SEQ ID NO: 4763 - protein, 160 aa, Unknown
  Description of Unknown: uncultivated organism with predicted taxonomy: Bacteroides sp. CAG:770
  MG16-39 HNH domain
ELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4764 - protein, 160 aa, Unknown; identical to SEQ ID NO: 4754
  Description of Unknown: uncultivated organism with predicted taxonomy: Bacteroides sp. CAG:770
  MG16-40 HNH domain

SEQ ID NO: 4765 - protein, 160 aa, Unknown
  Description of Unknown: uncultivated organism with predicted taxonomy: Bacteroides sp. CAG:770
  MG16-42 HNH domain
ELKLSKEGRESAAKNIRAREKANEEIAKRIEELGLLPSKNKILKYRLWEESGKRCFYCGQPVSATEFLNGLDVEIEHVVPKSLLFDDSFSNKVCACRKCNAEKGNATAFDFMNGRGENAFEDYLKRVETAFKENKISQTKRNRLLTPADKIPKDFISRQL

SEQ ID NO: 4766 - protein, 160 aa, Unknown; identical to SEQ ID NO: 4765
  Description of Unknown: uncultivated organism with predicted taxonomy: Bacteroides sp. CAG:770
  MG16-43 HNH domain

SEQ ID NO: 4767 - protein, 160 aa, Unknown
  Description of Unknown: uncultivated organism with predicted taxonomy: Bacteroides sp. CAG:770
  MG16-44 HNH domain
ELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQL

SEQ ID NO: 4768 - protein, 160 aa, Unknown; identical to SEQ ID NO: 4742
  Description of Unknown: uncultivated organism with predicted taxonomy: Bacteroides sp. CAG:770
  MG16-45 HNH domain

SEQ ID NO: 4769 - protein, 160 aa, Unknown
  Description of Unknown: uncultivated organism with predicted taxonomy: Bacteroides sp. CAG:770
  MG16-46 HNH domain
ELKLSKEGRAATAKNLRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4770 - protein, 160 aa, Unknown
  Description of Unknown: uncultivated organism with predicted taxonomy: Bacteroides sp. CAG:709
  MG16-47 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHRISFTKRSRLLTPADKIPKDFISRQL

SEQ ID NO: 4771 - protein, 160 aa, Unknown
  Description of Unknown: uncultivated organism with predicted taxonomy: Bacteroides sp. CAG:770
  MG16-48 HNH domain
ELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4772 - protein, 160 aa, Unknown; identical to SEQ ID NO: 4771
  Description of Unknown: uncultivated organism with predicted taxonomy: Bacteroides sp. CAG:770
  MG16-50 HNH domain

SEQ ID NO: 4773 - protein, 160 aa, Unknown; identical to SEQ ID NO: 4771
  Description of Unknown: uncultivated organism with predicted taxonomy: Bacteroides sp. CAG:770
  MG16-51 HNH domain

SEQ ID NO: 4774 - protein, 160 aa, Unknown; identical to SEQ ID NO: 4763
  Description of Unknown: uncultivated organism with predicted taxonomy: Bacteroides sp. CAG:770
  MG16-52 HNH domain

SEQ ID NO: 4775 - protein, 160 aa, Unknown; identical to SEQ ID NO: 4754
  Description of Unknown: uncultivated organism with predicted taxonomy: Bacteroides sp. CAG:709
  MG16-53 HNH domain

SEQ ID NO: 4776 - protein, 160 aa, Unknown; identical to SEQ ID NO: 4754
  Description of Unknown: uncultivated organism with predicted taxonomy: Bacteroides sp. CAG:709
  MG16-54 HNH domain

SEQ ID NO: 4777 - protein, 160 aa, Unknown
  Description of Unknown: uncultivated organism with predicted taxonomy: Bacteroides sp. CAG:770
  MG16-55 HNH domain
ELKLSKEGRESAAKNISDRKKANEEIARRIEELGLVPSKNKILKYRLWEESGKRCFYCGQPVSATEFLNGLDVEIEHVIPKSLLFDDSFSNKVCACRKCNAEKGNATAFDFMKGRGENAFEDYLKRVETAFKENRISQTKRSRLLTPADKIPKDFISRQL

SEQ ID NO: 4778 - protein, 160 aa, Unknown
  Description of Unknown: uncultivated organism with predicted taxonomy: Bacteroides sp. CAG:545
  MG16-56 HNH domain
KLKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4779 - protein, 160 aa, Unknown; identical to SEQ ID NO: 4743
  Description of Unknown: uncultivated organism with predicted taxonomy: Bacteroides sp. CAG:770
  MG16-57 HNH domain

SEQ ID NO: 4780 - protein, 160 aa, Unknown
  Description of Unknown: uncultivated organism with predicted taxonomy: Bacteroides sp. CAG:770
  MG16-58 HNH domain
ELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQL

SEQ ID NO: 4781 - protein, 160 aa, Unknown
  Description of Unknown: uncultivated organism with predicted taxonomy: Bacteroides sp. CAG:770
  MG16-59 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNNTAYDYMKSKGENEFNDYLRRVDAAFNEHKISFTKRSRLLTPADKLPKDFISRQL

SEQ ID NO: 4782 - protein, 160 aa, Unknown; identical to SEQ ID NO: 4741
  Description of Unknown: uncultivated organism with predicted taxonomy: Bacteroides sp. CAG:770
  MG16-60 HNH domain

SEQ ID NO: 4783 - protein, 160 aa, Unknown
  Description of Unknown: uncultivated organism with predicted taxonomy: Bacteroides sp. CAG:709
  MG16-61 HNH domain
ELKLSKEGRAATAKNIRDREKENKEIAEKIIELGVTPSKNKILKYRLWQEAGQKCFYCGQPVGATEFLNGLEVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4784 - protein, 160 aa, Unknown; identical to SEQ ID NO: 4741
  Description of Unknown: uncultivated organism with predicted taxonomy: Bacteroides sp. CAG:770
  MG16-62 HNH domain

SEQ ID NO: 4785 - protein, 160 aa, Unknown; identical to SEQ ID NO: 4741
  Description of Unknown: uncultivated organism with predicted taxonomy: Bacteroides sp. CAG:770
  MG16-63 HNH domain

SEQ ID NO: 4786 - protein, 160 aa, Unknown; identical to SEQ ID NO: 4756
  Description of Unknown: uncultivated organism with predicted taxonomy: Alistipes sp. CAG:514
  MG16-64 HNH domain

SEQ ID NO: 4787 - protein, 160 aa, Unknown
  Description of Unknown: uncultivated organism with predicted taxonomy: Bacteroides sp. CAG:770
  MG16-65 HNH domain
ELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQL

SEQ ID NO: 4788 - protein, 160 aa, Unknown
  Description of Unknown: uncultivated organism with predicted taxonomy: Bacteroides sp. CAG:770
  MG16-66 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNAHKISFTKRSRLLTPADKLPKDFISRQL

SEQ ID NO: 4789 - protein, 160 aa, Unknown; identical to SEQ ID NO: 4741
  Description of Unknown: uncultivated organism with predicted taxonomy: Bacteroides sp. CAG:545
  MG16-67 HNH domain

SEQ ID NO: 4790 - protein, 160 aa, Unknown; identical to SEQ ID NO: 4744
  Description of Unknown: uncultivated organism with predicted taxonomy: Bacteroides sp. CAG:770
  MG16-68 HNH domain

SEQ ID NO: 4791 - protein, 160 aa, Unknown; identical to SEQ ID NO: 4754
  Description of Unknown: uncultivated organism with predicted taxonomy: Bacteroides sp. CAG:709
  MG16-69 HNH domain

SEQ ID NO: 4792 - protein, 160 aa, Unknown; identical to SEQ ID NO: 4741
  Description of Unknown: uncultivated organism with predicted taxonomy: Bacteroides sp. CAG:770
  MG16-70 HNH domain

SEQ ID NO: 4793 - protein, 160 aa, Unknown; identical to SEQ ID NO: 4741
  Description of Unknown: uncultivated organism with predicted taxonomy: Bacteroides sp. CAG:545
  MG16-72 HNH domain

SEQ ID NO: 4794 - protein, 160 aa, Unknown; identical to SEQ ID NO: 4741
  Description of Unknown: uncultivated organism with predicted taxonomy: Bacteroides sp. CAG:545
  MG16-73 HNH domain

SEQ ID NO: 4795 - protein, 160 aa, Unknown
  Description of Unknown: uncultivated organism with predicted taxonomy: Bacteroides sp. CAG:770
  MG16-74 HNH domain
ELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKDNATAFDFMKGRGENAFEDYLKRVETAFKENKISQTKRNRLLTPADKIPKDFISRQL

SEQ ID NO: 4796 - protein, 160 aa, Unknown; identical to SEQ ID NO: 4754
  Description of Unknown: uncultivated organism with predicted taxonomy: Bacteroides sp. CAG:709
  MG16-75 HNH domain

SEQ ID NO: 4797 - protein, 160 aa, Unknown; identical to SEQ ID NO: 4754
  Description of Unknown: uncultivated organism with predicted taxonomy: Bacteroides
  MG16-76 HNH domain

SEQ ID NO: 4798 - protein, 160 aa, Unknown
  Description of Unknown: uncultivated organism with predicted taxonomy: Bacteroides sp. CAG:770
  MG16-77 HNH domain
ELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4799 - protein, 160 aa, Unknown; identical to SEQ ID NO: 4747
  Description of Unknown: uncultivated organism with predicted taxonomy: Bacteroides
  MG16-78 HNH domain

SEQ ID NO: 4800 - protein, 160 aa, Unknown
  Description of Unknown: uncultivated organism with predicted taxonomy: Bacteroides sp. CAG:770
  MG16-79 HNH domain
ELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHRISFIKRSRLLTPADKLPKDFISRQL

SEQ ID NO: 4801 - protein, 160 aa, Unknown; identical to SEQ ID NO: 4769
  Description of Unknown: uncultivated organism with predicted taxonomy: Bacteroides sp. CAG:545
  MG16-80 HNH domain

SEQ ID NO: 4802 - protein, 160 aa, Unknown; identical to SEQ ID NO: 4754
  Description of Unknown: uncultivated organism with predicted taxonomy: Bacteroides
  MG16-81 HNH domain

SEQ ID NO: 4803 - protein, 160 aa, Unknown
  Description of Unknown: uncultivated organism with predicted taxonomy: Bacteroides sp. CAG:770
  MG16-82 HNH domain
ELKLSKEGRAATAKNIRDREKMNNEMAEKIKELGITPSKNKLLKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQL

SEQ ID NO: 4804 - protein, 160 aa, Unknown; identical to SEQ ID NO: 4741
  Description of Unknown: uncultivated organism with predicted taxonomy: Bacteroides sp. CAG:545
  MG16-83 HNH domain

SEQ ID NO: 4805 - protein, 160 aa, Unknown
  Description of Unknown: uncultivated organism with predicted taxonomy: Bacteroidetes
  MG16-84 HNH domain
ELKESKDERESAFKRNNENERKNKEYEARIREYGIRPSRSRIQKYKMWEESQKKCFYCGKTIDVVEFLNGVDAEIEHIIPQSVLFDDSFSNKVCSCRDCNHTKGNLTAREFMEQHSAADYEAYLRRVDEAFDEHRISKTKRDHLLWRKEDIPQDFIDRQL

SEQ ID NO: 4806 - protein, 160 aa, Unknown; identical to SEQ ID NO: 4741
  Description of Unknown: uncultivated organism with predicted taxonomy: Bacteroides
  MG16-85 HNH domain

SEQ ID NO: 4807 - protein, 160 aa, Unknown; identical to SEQ ID NO: 4744
  Description of Unknown: uncultivated organism with predicted taxonomy: Bacteroides sp. CAG:545
  MG16-86 HNH domain

SEQ ID NO: 4808 - protein, 160 aa, Unknown; identical to SEQ ID NO: 4744
  Description of Unknown: uncultivated organism with predicted taxonomy: Bacteroides
  MG16-87 HNH domain

SEQ ID NO: 4809 - protein, 160 aa, Unknown; identical to SEQ ID NO: 4740
  Description of Unknown: uncultivated organism with predicted taxonomy: Bacteroides
  MG16-88 HNH domain

SEQ ID NO: 4810 - protein, 160 aa, Unknown; identical to SEQ ID NO: 4753
  Description of Unknown: uncultivated organism with predicted taxonomy: Bacteroides sp. CAG:709
  MG16-89 HNH domain

SEQ ID NO: 4811 - protein, 160 aa, Unknown; identical to SEQ ID NO: 4780
  Description of Unknown: uncultivated organism with predicted taxonomy: Bacteroides sp. CAG:770
  MG16-90 HNH domain

SEQ ID NO: 4812 - protein, 160 aa, Unknown; identical to SEQ ID NO: 4780
  Description of Unknown: uncultivated organism with predicted taxonomy: Bacteroides sp. CAG:770
  MG16-91 HNH domain

SEQ ID NO: 4813 - protein, 160 aa, Unknown; identical to SEQ ID NO: 4756
  Description of Unknown: uncultivated organism with predicted taxonomy: Alistipes sp. CAG:514
  MG16-92 HNH domain

SEQ ID NO: 4814 - protein, 160 aa, Unknown; identical to SEQ ID NO: 4756
  Description of Unknown: uncultivated organism with predicted taxonomy: Alistipes sp. CAG:514
  MG16-93 HNH domain

SEQ ID NO: 4815 - protein, 160 aa, Unknown; identical to SEQ ID NO: 4741
  Description of Unknown: uncultivated organism with predicted taxonomy: Bacteroides sp. CAG:545
  MG16-94 HNH domain

SEQ ID NO: 4816 - protein, 160 aa, Unknown; identical to SEQ ID NO: 4754
  Description of Unknown: uncultivated organism with predicted taxonomy: Bacteroides sp. CAG:709
  MG16-95 HNH domain

SEQ ID NO: 4817 - protein, 160 aa, Unknown; identical to SEQ ID NO: 4741
  Description of Unknown: uncultivated organism with predicted taxonomy: Bacteroides
  MG16-96 HNH domain

SEQ ID NO: 4818 - protein, 160 aa, Unknown
  Description of Unknown: uncultivated organism with predicted taxonomy: Bacteroides
  MG16-97 HNH domain
ELKLSKEGRAATAKNIRNREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4819 - protein, 160 aa, Unknown
  Description of Unknown: uncultivated organism with predicted taxonomy: Bacteroides sp. CAG:770
  MG16-98 HNH domain
ELKLSKEGRESAAKNIRAREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQL

SEQ ID NO: 4820 - protein, 160 aa, Unknown
  Description of Unknown: uncultivated organism with predicted taxonomy: Bacteroides sp. CAG:709
  MG16-99 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRDSTAYDYMKSKGENAFNDYLRRVDTAFSEHKISFTKRSRLLTPADKIPKDFISRQL

SEQ ID NO: 4821 - protein, 160 aa, Unknown
  Description of Unknown: uncultivated organism with predicted taxonomy: Bacteroides sp. CAG:709
  MG16-100 HNH domain
ELKLSKEGRAATAKNIRDREKENKEIAEKIIELDVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQL

SEQ ID NO: 4822 - protein, 160 aa, Unknown; identical to SEQ ID NO: 4741
  Description of Unknown: uncultivated organism with predicted taxonomy: Bacteroides sp. CAG:545
  MG16-101 HNH domain

SEQ ID NO: 4823 - protein, 160 aa, Unknown
  Description of Unknown: uncultivated organism with predicted taxonomy: Bacteroides sp. CAG:770
  MG16-102 HNH domain
ELKLSKAGRESAANNIRTRKKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4824 - protein, 160 aa, Unknown; identical to SEQ ID NO: 4767
  Description of Unknown: uncultivated organism with predicted taxonomy: Bacteroides sp. CAG:770
  MG16-103 HNH domain

SEQ ID NO: 4825 - protein, 160 aa, Unknown; identical to SEQ ID NO: 4754
  Description of Unknown: uncultivated organism with predicted taxonomy: Bacteroides
  MG16-104 HNH domain

SEQ ID NO: 4826 - protein, 160 aa, Unknown
  Description of Unknown: uncultivated organism with predicted taxonomy: Bacteroides sp. CAG:770
  MG16-105 HNH domain
ELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFIARQL

SEQ ID NO: 4827 - protein, 160 aa, Unknown; identical to SEQ ID NO: 4741
  Description of Unknown: uncultivated organism with predicted taxonomy: Bacteroides sp. CAG:545
  MG16-106 HNH domain

SEQ ID NO: 4828 - protein, 160 aa, Unknown; identical to SEQ ID NO: 4741
  Description of Unknown: uncultivated organism with predicted taxonomy: Bacteroides sp. CAG:545
  MG16-107 HNH domain

SEQ ID NO: 4829 - protein, 160 aa, Unknown; identical to SEQ ID NO: 4746
  Description of Unknown: uncultivated organism with predicted taxonomy: Bacteroides sp. CAG:770
  MG16-108 HNH domain

SEQ ID NO: 4830 - protein, 160 aa, Unknown; identical to SEQ ID NO: 4754
  Description of Unknown: uncultivated organism with predicted taxonomy: Bacteroides sp. CAG:709
  MG16-109 HNH domain

SEQ ID NO: 4831 - protein, 160 aa, Unknown; identical to SEQ ID NO: 4754
  Description of Unknown: uncultivated organism with predicted taxonomy: Bacteroides sp. CAG:709
  MG16-110 HNH domain

SEQ ID NO: 4832 - protein, 160 aa, Unknown; identical to SEQ ID NO: 4741
  Description of Unknown: uncultivated organism with predicted taxonomy: Bacteroides sp. CAG:770
  MG16-113 HNH domain

SEQ ID NO: 4833 - protein, 160 aa, Unknown; identical to SEQ ID NO: 4741
  Description of Unknown: uncultivated organism with predicted taxonomy: Bacteroides sp. CAG:545
  MG16-114 HNH domain

SEQ ID NO: 4834 - protein, 160 aa, Unknown; identical to SEQ ID NO: 4747
  Description of Unknown: uncultivated organism with predicted taxonomy: Bacteroides sp. CAG:770
  MG16-115 HNH domain

SEQ ID NO: 4835 - protein, 160 aa, Unknown; identical to SEQ ID NO: 4741
  Description of Unknown: uncultivated organism with predicted taxonomy: Bacteroides
  MG16-116 HNH domain

SEQ ID NO: 4836 - protein, 160 aa, Unknown; identical to SEQ ID NO: 4787
  Description of Unknown: uncultivated organism with predicted taxonomy: Bacteroides sp. CAG:770
  MG16-118 HNH domain

SEQ ID NO: 4837 - protein, 160 aa, Unknown; identical to SEQ ID NO: 4754
  Description of Unknown: uncultivated organism with predicted taxonomy: Bacteroides sp. CAG:709
  MG16-119 HNH domain

SEQ ID NO: 4838 - protein, 160 aa, Unknown; identical to SEQ ID NO: 4770
  Description of Unknown: uncultivated organism with predicted taxonomy: Bacteroides sp. CAG:709
  MG16-120 HNH domain

SEQ ID NO: 4839 - protein, 160 aa, Unknown
  Description of Unknown: uncultivated organism with predicted taxonomy: Bacteroides sp. CAG:770
  MG16-121 HNH domain
ELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGHGENAFEDYLKRVETAFKENRISQTKRNRLLTPADKIPKDFISRQL

SEQ ID NO: 4840 - protein, 160 aa, Unknown
  Description of Unknown: uncultivated organism with predicted taxonomy: Bacteroides sp. CAG:770
  MG16-122 HNH domain
ELKLSKAGRESAAKNIRTREKANEEIAKRIEELGLVPSKNKILKYRLWEEFGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFISRQL

SEQ ID NO: 4841 - protein, 160 aa, Unknown; identical to SEQ ID NO: 4747
  Description of Unknown: uncultivated organism with predicted taxonomy: Bacteroides sp. CAG:545
  MG16-123 HNH domain

SEQ ID NO: 4842 - protein, 160 aa, Unknown
  Description of Unknown: uncultivated organism with predicted taxonomy: Bacteroides sp. CAG:770
  MG16-126 HNH domain
ELKLSKEGRAATAKNIRDREKMNNEMAEKIKELGITPSKNKILKYRLWQESGQKCFYCGQPVGAAEFLCGLDVEIEHIVPKALLFDDSFSNKVCACRKCNAEKSNTTAYDYMKSKGENEFNDYLRRVDAAFNEHKISFTKRSRLLTPADKLPKDFISRQL

SEQ ID NO: 4843 - protein, 160 aa, Unknown; identical to SEQ ID NO: 4754
  Description of Unknown: uncultivated organism with predicted taxonomy: Bacteroides sp. CAG:709
  MG16-127 HNH domain

SEQ ID NO: 4844 - protein, 160 aa, Unknown; identical to SEQ ID NO: 4741
  Description of Unknown: uncultivated organism with predicted taxonomy: Bacteroides sp. CAG:770
  MG16-128 HNH domain

SEQ ID NO: 4845 - protein, 160 aa, Unknown; identical to SEQ ID NO: 4754
  Description of Unknown: uncultivated organism with predicted taxonomy: Bacteroides sp. CAG:709
  MG16-129 HNH domain

SEQ ID NO: 4846 - protein, 160 aa, Unknown
  Description of Unknown: uncultivated organism with predicted taxonomy: Bacteroides sp. CAG:770
  MG16-130 HNH domain
ELKLSKAGRESAANNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQL

SEQ ID NO: 4847 - protein, 160 aa, Unknown
  Description of Unknown: uncultivated organism with predicted taxonomy: Bacteroides sp. CAG:709
  MG16-131 HNH domain
ELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFVSRQL

SEQ ID NO: 4848 - protein, 160 aa, Unknown; identical to SEQ ID NO: 4741
  Description of Unknown: uncultivated organism with predicted taxonomy: Bacteroides
  MG16-132 HNH domain

SEQ ID NO: 4849 - protein, 174 aa, Unknown
  Description of Unknown: uncultivated organism with predicted taxonomy: Bacteroidales
  MG16-133 HNH domain
ELKQSKEEREKTDRGIRKQQKANEVFANLLKEQGVRPTRNRILKYRLWRESYETCFYCGQPISFKEFLKFSDVEREHVIPKRLLYDDSFANQVCSCRKCNAEKGGRTAIDYMRTTQHLQPYLEKVDKMFQEHKISGKKHAHLLASYDDYLSRKKEGKETKDDIIIWEEAIERQL

SEQ ID NO: 4850 - protein, 197 aa, Unknown
  Description of Unknown: uncultivated organism
  MG16-134 HNH domain
ELKQSKDDRNTTYLQNEAMERLNDAIAKRLNSEGIKTTKRILEKYKYIFPTKGCIDKKTGKFVSKNFENLSTVNQCIYCGKSFSLTAALNGDGYEVEHIIPRDLICDNSQSNKVLSCRSCNSKKSNKTAFDFMRGQGEQALEDYIARIEKWYKDGIISPAKREHLLLSHEDYLKRKKEGKTTDEDKKYWEDFVSRQA

SEQ ID NO: 4851 - protein, 197 aa, Unknown
  Description of Unknown: uncultivated organism with predicted taxonomy: Porphyromonas sp. oral taxon 278
  MG16-135 HNH domain
ELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKRKDKATDIDKKYWEDFVSRQA

SEQ ID NO: 4852 - protein, 160 aa, Unknown
  Description of Unknown: uncultivated organism with predicted taxonomy: Bacteroidales
  MG16-136 HNH domain
ELKQSRDERNDAYLSINKRERENKVIEERIREYGISPSKSRIQKYRLWEESNHLCFYCGHPVGAAEFLSGSGVEIEHIIPRSLLFDDSFANKVCACRQCNAEKGNSTAFDYMKSKPANDFEDYLKRVEKYFTEKRISKTKRERLLTPASEIPQDFIDRQL

SEQ ID NO: 4853 - protein, 174 aa, Unknown
  Description of Unknown: uncultivated organism with predicted taxonomy: Prevotella
  MG16-137 HNH domain
ELKQSKDERNETEIGIRKQQKLNDEYAKILKEEGVRPTRNRILKYRLWRESNKSCFYCEQPISFHEFLDFSETEREHIIPKKLMYDDSFANQVCSCRNCNKEKGGRTAMDYMRTKQNLQFYLDKVDKMFQDHKISGKKRSHLLASYDDYLFRKENGKETKDDILIWEKPIERQL

SEQ ID NO: 4854 - protein, 160 aa, Unknown
  Description of Unknown: uncultivated organism
  MG16-138 HNH domain
ELKQSRDERNSAFLNNNKRERDNKAISERIQEMGIRASRSRILKYRLWEEAKHICFYCGQTVGVKEFLEGTDVEIEHIIPRSLFFDDSFSNKVCACRKCNAEKGNRTAYDYMKQKSDNDFADYTRRIEDAYEKKEISKTKRERLLTTAKDIPEDFIDRQL

SEQ ID NO: 4855 - protein, 161 aa, Unknown
  Description of Unknown: uncultivated organism with predicted taxonomy: Bacteroidales
  MG16-139 HNH domain
ELKQSRDERESAYKAINKNERENSTIANRILEDYGIRPSRSRIQKYRMWEESKQRCFYCGKMIDVKQFLSGADVEIEHIVPRSILFDDSYSNKVCACRECNQEKGNLTAMEYMEGKPTGEFEAYKQRVDEAFSEHRISKTKRDHLLWRRADIPQDFIERQL

SEQ ID NO: 4856 - protein, 160 aa, Unknown
  Description of Unknown: uncultivated organism with predicted taxonomy: Fibrobacter
  MG16-140 HNH domain
ELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQL

SEQ ID NO: 4857 - protein, 160 aa, Unknown
  Description of Unknown: uncultivated organism with predicted taxonomy: Bacteroidales
  MG16-141 HNH domain
ELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPAAEVEAYKQRVDEAFKEGRISKTKRDHLLWHKSDIPTDFIDRQL

SEQ ID NO: 4858 - protein, 160 aa, Unknown
  Description of Unknown: uncultivated organism with predicted taxonomy: Bacteroidales
  MG16-142 HNH domain
ELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQL

SEQ ID NO: 4859 - protein, 160 aa, Unknown
  Description of Unknown: uncultivated organism with predicted taxonomy: Deminuibacter soli
  MG16-143 HNH domain
ELKQSRDERNDAFLKNNKRERENKVIEERIREYGITPSRSRIQKYRLWEESNHLCFYCGQPVGAAEFLSGSGVEIEHIIPRSLLFDDSYANKVCSCRKCNAEKGNSTAYDYMKAKPEGDFEDYLKRIEKFFSEKRISKSKREKLLTPASEIPQDFIDRQL

SEQ ID NO: 4860 - protein, 197 aa, Unknown
  Description of Unknown: uncultivated organism with predicted taxonomy: Bacteroidales
  MG16-144 HNH domain
ELKQSKDERNTTFLQNEAMQRLNESIAKRLVSENINPTKRIIDKYKFIFPTKGCFDKRTGKFITKNFESLSTVNRCIYCGQSFSLSEALNGDGYEIEHILPRDLICDNSQNNKVLSCRKCNSIKSNKTAFDYMRTQDKNAFEAYLERVESWYKDGIISPAKRERLLLSHEDYLERKRIGKETDEDKKYWEEFVSRQA

SEQ ID NO: 4861 - protein, 197 aa, Unknown
  Description of Unknown: uncultivated organism with predicted taxonomy: Bacteroides
  MG16-145 HNH domain
ELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQA

SEQ ID NO: 4862 - protein, 160 aa, Unknown
  Description of Unknown: uncultivated organism with predicted taxonomy: Bacteroidetes
  MG16-146 HNH domain
ELKQSKDERNSTFLNNNKRERENKIIEERIAEMGIRPSRSRILKYRLWEEAKHICFYCGQPVGVKEFLEGAEVEIEHIIPRSLFFDDSFANKVCSCRKCNAEKGNRTAFDYMKQKGENEFSDYSRRIEEAFEKKEISKVKRERLLTSAKDIPEDFIDRQL

SEQ ID NO: 4863 - protein, 160 aa, Unknown
  Description of Unknown: uncultivated organism with predicted taxonomy: Bacteroidales
  MG16-147 HNH domain
ELKQSREERESAYRAMGQNERRNKEIAEKISEFGIRPSRSRIQKYKMWEESMHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPADFIERQL

SEQ ID NO: 4864 - protein, 160 aa, Unknown
  Description of Unknown: uncultivated organism with predicted taxonomy: Bacteroidales
  MG16-148 HNH domain
ELKQSRDERESAYKAMGQNERRNKEIAAKITEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPSDFIERQL

SEQ ID NO: 4865 - protein, 197 aa, Unknown
  Description of Unknown: uncultivated organism with predicted taxonomy: Bacteroidetes
  MG16-149 HNH domain
ELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKKKGKITDIDKKYWEDFVSRQA

SEQ ID NO: 4866 - protein, 174 aa, Unknown
  Description of Unknown: uncultivated organism with predicted taxonomy: Bacteroidales
  MG16-150 HNH domain
ELKQSKTEREEASAGIRKQQALNDNYANILKSESIRPTRNKILKYRLWTESNKTCFYCDQPVNFKEYLQTTEFEREHVIPKRLIFDDSFANQVCSCSKCNKEKGGLTALDFMRTKANLRNYLDKVDSMYQKHEISGKKRSHLLASYDDYLERKKEGKETKEDIMIWETPIDRQL

SEQ ID NO: 4867 - protein, 197 aa, Unknown; identical to SEQ ID NO: 4861
  Description of Unknown: uncultivated organism with predicted taxonomy: Prevotella
  MG16-151 HNH domain

SEQ ID NO: 4868 - protein, 161 aa, Unknown
  Description of Unknown: uncultivated organism with predicted taxonomy: Fibrobacter
  MG16-152 HNH domain
ELKQSKDERNTTFNNIAKRERENKGIAERIKNEYGLIPNRNKIEKYRLWEEAEQKCFYCGQTVNVKEFLSGFDVEVEHVIPKSLLFDDSYANKVCACRKCNANKGNKTAFDFMKSQSEDAFNNYVSRVEEYYKNGKISRTKHDRLLTPQSEIPSDFIERQL

SEQ ID NO: 4869 - protein, 160 aa, Unknown
  Description of Unknown: uncultivated organism with predicted taxonomy: Bacteroidales
  MG16-153 HNH domain
ELKQSREEREGAYRRNNQNERLNKEIIAKIEEMGIRPSRSRIQKYKMWEENNHRCMYCGKTVSLAEFLNGADVEIEHIIPRSILFDDSFSNKVCACRECNHEKGNMTALDYIETKPAAEQEAYKQRVDEAFKEGRISKTKRDHLLWHRSEIPTDFIERQL

SEQ ID NO: 4870 - protein, 160 aa, Unknown
  Description of Unknown: uncultivated organism with predicted taxonomy: Bacteroidales
  MG16-154 HNH domain
ELKQSRDERESAYKAMGQNERRNKEIAAKIAEFGIRPSRSRIQKYKMWEESQHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQL

SEQ ID NO: 4871 - protein, 160 aa, Unknown
  Description of Unknown: uncultivated organism with predicted taxonomy: Bacteroidales
  MG16-155 HNH domain
ELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQL

SEQ ID NO: 4872 - protein, 160 aa, Unknown
  Description of Unknown: uncultivated organism with predicted taxonomy: Bacteroidales
  MG16-156 HNH domain
ELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQL

SEQ ID NO: 4873 - protein, 160 aa, Unknown
  Description of Unknown: uncultivated organism with predicted taxonomy: Fibrobacter
  MG16-157 HNH domain
ELKQSKDERKATAANIAKRERENKAIAAKIEEFGIRPSRNRIQKYRLWEESEQKCFYCGQPVDAREFLSGLDVEVEHIIPKSLLFDDSFANKVCACRKCNAAKGNRTAFDYMKSQSSNAFDAYIKRVNDFYKDGKISKTKNERLLTTQSEIPSDFIERQL

SEQ ID NO: 4874 - protein, 160 aa, Unknown
  Description of Unknown: uncultivated organism with predicted taxonomy: Bacteroidetes
  MG16-158 HNH domain
ELKQSRDERNNAFLNNNKRERENKVLEERIREYGISPSRSRIQKYRLWEESNHLCFYCGQPVGAAEFLSGSGVEIEHIIPRSLLFDDSYANKVCSCRKCNAEKGNSTAYDYMKAKPEGDFEDYLKRIETFFSEKRISKAKRDKLLTPATDIPQDFIDRQL

SEQ ID NO: 4875 - protein, 177 aa, Unknown
  Description of Unknown: uncultivated organism with predicted taxonomy: Bacteroidetes
  MG16-159 HNH domain
ELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQL

SEQ ID NO: 4876 - protein, 160 aa, Unknown
  Description of Unknown: uncultivated organism with predicted taxonomy: Fibrobacter
  MG16-160 HNH domain
ELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQL

SEQ ID NO: 4877 - protein, 160 aa, Unknown
  Description of Unknown: uncultivated organism with predicted taxonomy: Bacteroidales
  MG16-161 HNH domain
ELKQSREERENAYKRNNQNERLNKEIAAKIEEMGIRPSRSRIQKYKMWEESDHRCMYCGKMVSLAEFLNGADVEIEHIIPRSILFDDSYSNKVCACRDCNREKDNLTALDYLETKTGAELEAYKQRVDDAFKEGRISKTKRDHLLWRREDIPSDFIERQL

SEQ ID NO: 4878 - protein, 177 aa, Unknown
  Description of Unknown: uncultivated organism with predicted taxonomy: Prevotella
  MG16-162 HNH domain
ELKQSKDERNEAFKRNNQNEKKNKEYAEHIKEYQLTPTRNRLLKWKLYEESDHACMYCGQPIKVREFLQGADVEREHIIPKGLLFDNSFTNQVCSCRSCNSKKGMRTAYDFIEAEKGEEGLRSYIEHINYLFDKKNISRSKYNRLLVSYKAYLQRKVQGKETEEDKNLWENFIDRQL

SEQ ID NO: 4879 - protein, 197 aa, Unknown; identical to SEQ ID NO: 4861
  Description of Unknown: uncultivated organism with predicted taxonomy: Bacteroides
  MG16-163 HNH domain

SEQ ID NO: 4880 - protein, 177 aa, Unknown
  Description of Unknown: uncultivated organism with predicted taxonomy: Prevotella
  MG16-164 HNH domain
ELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQL

SEQ ID NO: 4881 - protein, 160 aa, Unknown
  Description of Unknown: uncultivated organism
  MG16-165 HNH domain
ELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPATEVEAYKQRVDEAFKEGQISKTKRDHLLWHRSDIPTDFIDRQL

SEQ ID NO: 4882 - protein, 177 aa, Unknown
  Description of Unknown: uncultivated organism with predicted taxonomy: Bacteroidales
  MG16-166 HNH domain
ELKQNREERNEAFKRNAQNEKLNKEYAERIKEYGLTPTRNRIMKMKMWEESENTCMYCGQPVDVVEFLQGADVEREHIIPRGLLFDNSFTNQVCSCRKCNSQKGMRTAYDFIEDEKGQEGLESYIKHINYLFDKKKINRSKLNRLLVSHKAYINRKSLGKETEEDKQLWENFIDRQL

SEQ ID NO: 4883 - protein, 160 aa, Unknown
  Description of Unknown: uncultivated organism with predicted taxonomy: Bacteroidales
  MG16-167 HNH domain
ELKQSRDERESAYKAMGQNERRNKEIAAKIAEFGIRSSRSRIQKYKMWEESLHQCFYCGKTIDLSEFLNGADVEIEHIIPRSILFDDSFSNKVCACRRCNQEKGNQTAMEYMETKSASEQEAYKQRVDEAFTTKRISLTKRDHLLWHKADIPSDFIDRQE

SEQ ID NO: 4884 - protein, 174 aa, Unknown
  Description of Unknown: uncultivated organism with predicted taxonomy: Barnesiella viscericola
  MG16-168 HNH domain
ELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQL

SEQ ID NO: 4885 - protein, 160 aa, Unknown; identical to SEQ ID NO: 4858
  Description of Unknown: uncultivated organism with predicted taxonomy: Bacteroidales
  MG16-169 HNH domain

SEQ ID NO: 4886 - protein, 160 aa, Unknown; identical to SEQ ID NO: 4854
  Description of Unknown: uncultivated organism
  MG16-170 HNH domain

SEQ ID NO: 4887 - protein, 160 aa, Unknown; identical to SEQ ID NO: 4877
  Description of Unknown: uncultivated organism with predicted taxonomy: Bacteroidales
  MG16-171 HNH domain

SEQ ID NO: 4888 - protein, 160 aa, Unknown
  Description of Unknown: uncultivated organism with predicted taxonomy: Prevotella brevis
  MG16-172 HNH domain
ELKQSREEREGAYRRNNQNERLNKEIAAKIEEMGIRPSRSRIQKYKMWEETNHRCMYCGKTVSLAEFLNGADVEIEHIIPRSILFDDSFSNKVCACRECNHEKGNMTALDYIETKPAAEVEAYKQRVDEAFKEGQISKTKRDHLLWHKSDIPTDFIDRQL

SEQ ID NO: 4889 - protein, 197 aa, Unknown; identical to SEQ ID NO: 4861
  Description of Unknown: uncultivated organism with predicted taxonomy: Bacteroides
  MG16-173 HNH domain

SEQ ID NO: 4890 - protein, 160 aa, Unknown
  Description of Unknown: uncultivated organism with predicted taxonomy: Bacteroidetes
  MG16-174 HNH domain
ELKQSRDERESAYKAMGKNERRNKEIAEKIAEFGIRPSRSRIQKYKMWEESMHQCFYCGKTIDLAEFLNGADVEIEHIIPRSILFDDSFSNKVCACRRCNQEKSNQTAMEYMETKPVGELEAYKRRVDEAFTAKRISKTKRDHLLWRKADIPTDFIERQL

SEQ ID NO: 4891 - protein, 174 aa, Unknown; identical to SEQ ID NO: 4884
  Description of Unknown: uncultivated organism with predicted taxonomy: Prevotella
  MG16-175 HNH domain

SEQ ID NO: 4892 - protein, 160 aa, Unknown
  Description of Unknown: uncultivated organism with predicted taxonomy: Bacteroidales
  MG16-176 HNH domain
ELKQSRDERESAYKAMGQNERRNKEIAAKIAEFGIRPSRSRIQKYKMWEESLHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQL

SEQ ID NO: 4893 - protein, 160 aa, Unknown; identical to SEQ ID NO: 4869
  Description of Unknown: uncultivated organism with predicted taxonomy: Bacteroidia
  MG16-177 HNH domain

SEQ ID NO: 4894 - protein, 160 aa, Unknown; identical to SEQ ID NO: 4872
  Description of Unknown: uncultivated organism with predicted taxonomy: Porphyromonas sp. oral taxon 278
  MG16-178 HNH domain

SEQ ID NO: 4895 - protein, 160 aa, Unknown; identical to SEQ ID NO: 4854
  Description of Unknown: uncultivated organism
  MG16-179 HNH domain

SEQ ID NO: 4896 - protein, 160 aa, Unknown
  Description of Unknown: uncultivated organism with predicted taxonomy: Bacteroidales
  MG16-180 HNH domain
ELKQSREERENAFKRNNQNERLNKEIADKIEEMGIRPSRSRIQKYKMWEESNHRCMYCGKTVSLAEFLNGADVEIEHIIPRSILFDDSFSNKVCACRECNHEKDNMTALDYLETKPAVEVDAYKQRVDEAFKEGRISKTKRDHLLWHKSDIPQDFIDRQL

SEQ ID NO: 4897 - protein, 160 aa, Unknown; identical to SEQ ID NO: 4872
  Description of Unknown: uncultivated organism with predicted taxonomy: Bacteroidales
  MG16-181 HNH domain

SEQ ID NO: 4898 - protein, 177 aa, Unknown; identical to SEQ ID NO: 4875
  Description of Unknown: uncultivated organism with predicted taxonomy: Prevotella
  MG16-182 HNH domain

SEQ ID NO: 4899 - protein, 177 aa, Unknown
  Description of Unknown: uncultivated organism with predicted taxonomy: Prevotella
  MG16-183 HNH domain
ELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMNRKAQGKETEEDKELWENFIDRHL

SEQ ID NO: 4900 - protein, 160 aa, Unknown; identical to SEQ ID NO: 4872
  Description of Unknown: uncultivated organism with predicted taxonomy: Bacteroidales
  MG16-184 HNH domain

SEQ ID NO: 4901 - protein, 160 aa, Unknown; identical to SEQ ID NO: 4876
  Description of Unknown: uncultivated organism with predicted taxonomy: Fibrobacter
  MG16-185 HNH domain

SEQ ID NO: 4902 - protein, 177 aa, Unknown; identical to SEQ ID NO: 4880
  Description of Unknown: uncultivated organism with predicted taxonomy: Prevotella
  MG16-186 HNH domain

SEQ ID NO: 4903 - protein, 160 aa, Unknown
  Description of Unknown: uncultivated organism with predicted taxonomy: Bacteroidales
  MG16-187 HNH domain
ELKQSRDERESAYRAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQL

SEQ ID NO: 4904 - protein, 177 aa, Unknown
  Description of Unknown: uncultivated organism
  MG16-188 HNH domain
ELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQL

SEQ ID NO: 4905 - protein, 177 aa, Unknown; identical to SEQ ID NO: 4904
  Description of Unknown: uncultivated organism
  MG16-189 HNH domain

SEQ ID NO: 4906 - protein, 177 aa, Unknown
  Description of Unknown: uncultivated organism with predicted taxonomy: Prevotella ruminicola
  MG16-190 HNH domain
ELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMSRKAQGKETDEDKELWENFIDRQL

SEQ ID NO: 4907 - protein, 160 aa, Unknown
  Description of Unknown: uncultivated organism with predicted taxonomy: Labilibaculum filiforme
  MG16-191 HNH domain
ELKQSRDERESAYKAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQL

SEQ ID NO: 4908 - protein, 177 aa, Unknown
  Description of Unknown: uncultivated organism with predicted taxonomy: Bacteroidales
  MG16-192 HNH domain
ELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQL

SEQ ID NO: 4909 - protein, 160 aa, Unknown
  Description of Unknown: uncultivated organism
  MG16-193 HNH domain
ELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQL

SEQ ID NO: 4910 - protein, 177 aa, Unknown
  Description of Unknown: uncultivated organism with predicted taxonomy: Sediminibacterium sp. C3
  MG16-194 HNH domain
ELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWDNFIDRQL

SEQ ID NO: 4911 - protein, 175 aa, Unknown
  Description of Unknown: uncultivated organism with predicted taxonomy: Bacteroides
  MG16-195 HNH domain
ELKQSKDERHDTSEVIKALENKNKEYKTFIEKEYKLKATRKNLLRYRLWIESNQSCFYCLKPIKFTPFANESEEEREHILPKALHYDDSFANQVCSCKDCNSTKGGRTAMDYMRTTPYLQHYIDRVNKLYQANKISGKKYSHLLASYDDYQLRKKEGKETKEDILIWEKPIDRQL

SEQ ID NO: 4912 - protein, 177 aa, Unknown
  Description of Unknown: uncultivated organism with predicted taxonomy: Gammaproteobacteria bacterium
  MG16-196 HNH domain
ELKQSKDERNEAFKRNSQNERENKEYAERIKEYGLTPTRNRIMKMRMWEESEYTCMYCGQPVNVVEFLKGADVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQL

SEQ ID NO: 4913 - protein, 174 aa, Unknown
  Description of Unknown: uncultivated organism with predicted taxonomy: Bacteroides
  MG16-197 HNH domain
ELKQSKDERKEASDGIRKQQKRNEEYAKMLVEEGVRPTRNRILRYRLWEESNKRCFYCGQPISFNEFIKSSDAEREHVIPKALMFDDSFANQVCSCRECNKEKGGRTALDYMRTKSNLQAYLDRVDDMYQSHQIGGKKHSHLLASYDDYLSRKKEGKETKEDIMIWETPIERQL

SEQ ID NO: 4914 - protein, 177 aa, Unknown
  Description of Unknown: uncultivated organism with predicted taxonomy: Bacteroidales
  MG16-198 HNH domain
ELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYINRKALGKETDEDKELWENFIDRQL

SEQ ID NO: 4915 - protein, 177 aa, Unknown; identical to SEQ ID NO: 4908
  Description of Unknown: uncultivated organism with predicted taxonomy: Gammaproteobacteria bacterium
  MG16-199 HNH domain

SEQ ID NO: 4916 - protein, 160 aa, Unknown
  Description of Unknown: uncultivated organism with predicted taxonomy: Fibrobacter
  MG16-200 HNH domain
ELKQSKDERNTTASNIAKKERENKNIEAKIQEFGIRSSRNRIQKYRLWEESEQKCFYCGQPVQAKEFLSGLDVEVEHIIPKSLLFDDSFANKVCACRKCNADKGNKTAYDFMKGQKTEVFDAYVKRVNDFYKDGKISKTKKERLLTTQSEIPSDFIERQL

SEQ ID NO: 4917 - protein, 197 aa, Unknown
  Description of Unknown: uncultivated organism with predicted taxonomy: Prevotella
  MG16-201 HNH domain
ELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQA

SEQ ID NO: 4918 - protein, 161 aa, Unknown
  Description of Unknown: uncultivated organism
  MG16-202 HNH domain
ELKQSRDERESAYKAMGQNERRNKEIAAKIAEFGIRPSRSRIQKYKMWEESQHRCFYCGEMMDLTQFLNGADVEIEHIIPRSILFDDSYSNKVCACRRCNQEKGNMTAMEYMEAKPSAEFEAYKQRVDDVFNKDHRISKTKRDHLLWRRADIPQDFIDRQL

SEQ ID NO: 4919 - protein, 174 aa, Unknown
  Description of Unknown: uncultivated organism with predicted taxonomy: Bacteroides sp. CAG:144
  MG16-203 HNH domain
ELKQSKEERDETSKGISKQQKLNDEYANLLKESGIRPTRNKITRYRLWREANETCFYCGQPVNFNEFVKFSEAEREHIIPKSLILDDSFANQVCSCRKCNAEKGGRTAIDYMRTTPYLQAYLTKVDEMFQGHKISGKKHAHLLASYEDYLVRKQQGKETKEDVNIWEAPIDRQL

SEQ ID NO: 4920 - protein, 177 aa, Unknown
  Description of Unknown: uncultivated organism with predicted taxonomy: Bacteroidales
  MG16-204 HNH domain
ELKQSKDERNEAFRRNNQNERLNKELAERIKKYGLTPTRNRIMKLKMWEESEHSCMYCKQPVDPVEFLKGADVEREHIIPRALLFDNSFTNQVCSCRRCNSKKGMRTAYDFIADEKGQEGLNAYIEHINDLFDKKKISRSKLNRLLVSHKAYISRKAQGKETDEDKELWENFIDRQL

SEQ ID NO: 4921 - protein, 160 aa, Unknown; identical to SEQ ID NO: 4916
  Description of Unknown: uncultivated organism with predicted taxonomy: Fibrobacter
  MG16-205 HNH domain

SEQ ID NO: 4922 - protein, 177 aa, Unknown; identical to SEQ ID NO: 4908
  Description of Unknown: uncultivated organism with predicted taxonomy: Gammaproteobacteria bacterium
  MG16-206 HNH domain

SEQ ID NO: 4923 - protein, 174 aa, Unknown
  Description of Unknown: uncultivated organism
  MG16-207 HNH domain
ELKQSKEERDETSKGISKQQKLNDEYANLLKGKGIRPTRNKITRYRLLMESNETCFYCGQPVNFNEFVKFSEAEREHIIPKSLILDDSFANQVCSCRKCNAEKGGRTAIDYMRTTPHLQAFLSKVDEMFQGHKISGKKHAHLLASYEDYLVRKKQGKETKEDVNIWETPIDRQL

SEQ ID NO: 4924 - protein, 174 aa, Unknown
  Description of Unknown: uncultivated organism
  MG16-208 HNH domain
ELKQSKDEREKTSKDIRANKKKNDECAERVKEYGFSPTRNRIMRYKMWVETNHRCIYCNDGVNVKDFLSGVDVEREHIIPKALLFDDSFSNQTCSCRKCNRDKGSRTALDYIRDCGREEEYITRVNELLEKRQISKTKYNHLLTSYRDYLERKTQGKETQEDKDLWEHFIDRQL

SEQ ID NO: 4925 - protein, 197 aa, Unknown; identical to SEQ ID NO: 4917
  Description of Unknown: uncultivated organism with predicted taxonomy: Chryseobacterium vrystaatense
  MG16-209 HNH domain

SEQ ID NO: 4926 - protein, 160 aa, Unknown
  Description of Unknown: uncultivated organism
  MG16-210 HNH domain
ELKQSKDERNEVFLRNNKRERENAEIIKRIEEYGVRPSRSRIQKYRLWEESNQICFYCGNTVGVKEFLSGVDAEIEHIIPRSLFFDDSFSNKVCACRACNQEKGNRTAYDYMQSKSEIEFDNYLRRVENYYNEKKISKTKRERLLTAAKDIPQDFLDRQL

SEQ ID NO: 4927 - protein, 197 aa, Unknown
  Description of Unknown: uncultivated organism with predicted taxonomy: Prevotella
  MG16-211 HNH domain
ELKQSKDERNTTFLQNEAMQRLNESIAKRLSFEDIKPTKRTIEKYKFIFPTKGCIDKRTGKFVTKSFDGLSTINQCIYCGQPFSLSAALNGDGYEIEHIIPRDLLCDNSQNNKVLSCRKCNSRKSNKTAFDFMRSQDESIFEEYLERIELWYKNGIISPTKREHLLLSHEDYLERKKKGKVTDIDKKYWEDFVSRQV

SEQ ID NO: 4928 - protein, 177 aa, Unknown; identical to SEQ ID NO: 4878
  Description of Unknown: uncultivated organism with predicted taxonomy: Prevotella ihumii
  MG16-212 HNH domain

SEQ ID NO: 4929 - protein, 160 aa, Unknown
  Description of Unknown: uncultivated organism with predicted taxonomy: Treponema pedis
  MG16-213 HNH domain
ELKQSKDERNEVFLRNNKRERENAEITKRIEEYGIRPSRSRIQKYRLWEESNHICFYCGQPVGAKEFLSGVDVEIEHIIPRSLFFDDSFSNKVCACRKCNQDKGNSTAFDFMKAKPEVEFDNYLRRVESYYNEKRISKTKRDRLLTAAKDIPEDFINRQL

SEQ ID NO: 4930 - protein, 177 aa, Unknown
  Description of Unknown: uncultivated organism with predicted taxonomy: Sediminibacterium sp. C3
  MG16-214 HNH domain
ELKQSKDERNETFKRNNQNERQNKEYAERIKEYGLTPTRNRIMKMKMWEESEYTCMYCGQPVNVTEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQL

SEQ ID NO: 4931 - protein, 177 aa, Unknown
  Description of Unknown: uncultivated organism with predicted taxonomy: Prevotella
  MG16-215 HNH domain
ELKQSRDERNETFKRNNQNERQNKVYAERIKEYGLTPTRNRIMKMKMWEESEYTCMYCGQPVNVTEFLKGADVEREHIIPRGLLFDNSFTNQVCSCRRCNSKKGMRTAYDFIADDKGQDGLNAYIDRINNLFDKKKISRSKLNRLLVSHKAYISRKAQGKETDEDKELWENFIDRQL

SEQ ID NO: 4932 - protein, 177 aa, Unknown
  Description of Unknown: uncultivated organism with predicted taxonomy: Bacteroidales
  MG16-216 HNH domain
ELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQL

SEQ ID NO: 4933 - protein, 177 aa, Unknown
  Description of Unknown: uncultivated organism with predicted taxonomy: Porphyromonas catoniae
  MG16-217 HNH domain
ELKQSKDERNEAFKRNNQNERQNKEYAERIKVYGLTPTRNRIMKMKMWEESEYTCMYCGQPVNVTEFLQGADVEREHIIPRGLLFDNSFTNQVCSCRRCNSKKGMRTAYDFIADDKGQEGLDAYIDRINDLFNKKKISRSKLNRLLVSHKAYIIRKTQGKETEEDKELWENFIDRQL

SEQ ID NO: 4934 - protein, 177 aa, Unknown
  Description of Unknown: uncultivated organism with predicted taxonomy: Prevotella
  MG16-218 HNH domain
ELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMRRKAQGKETDEDKELWENFIDRQL

SEQ ID NO: 4935 - protein, 161 aa, Unknown
  Description of Unknown: uncultivated organism with predicted taxonomy: Fibrobacter
  MG16-219 HNH domain
ELKQSKDERNTTFNNIAKRERENKGIAERIKNEYGLIPNRNKIEKYRLWEEAEQKCFYCGQTVNVKEFLSGFDVEVEHVIPKSLLFDNSYANKVCACRKCNANKGNKTAFDFMKSQSEDAFNNYVSRVEEYYKNGKISRTKHDRLLTPQSEIPSDFIERQL

SEQ ID NO: 4936 - protein, 177 aa, Unknown; identical to SEQ ID NO: 4932
  Description of Unknown: uncultivated organism with predicted taxonomy: Sediminibacterium sp. C3
  MG16-220 HNH domain

SEQ ID NO: 4937 - protein, 177 aa, Unknown
  Description of Unknown: uncultivated organism with predicted taxonomy: Sediminibacterium sp. C3
  MG16-221 HNH domain
ELKQSKDERNETFKRNSQNERNNKEYAERIKEYGLTPTRNRIMKMKMWEESEYTCVYCGQPVNVTEFLKGADVEREHIIPRGLLFDNSFTNQVCSCRLCNSKKGMRTAYDFIADDKGQAGLETYIDRINDLFNRKKISRSKFNRLLVSYKAYISRKAKGKETEEDKELWENFIDRQL

SEQ ID NO: 4938 - protein, 177 aa, Unknown
  Description of Unknown: uncultivated organism with predicted taxonomy: Prevotella sp. ne3005
  MG16-222 HNH domain
ELKQSKDERNETFKRNNQNERQNKEYAERIKKYSLTPTRNRIMKLKMWEESEHACMYCEEPVDPIEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQL

SEQ ID NO: 4939 - protein, 177 aa, Unknown
  Description of Unknown: uncultivated organism with predicted taxonomy: Prevotella copri
  MG16-223 HNH domain
ELKQSKDERNETYRRNNQNEKKNNEYAERIKEYGLTPTRNRIMKMKMLEESEYKCMYCGQPVREKEFLQGADVEREHIIPKALLFDNSFTNQVCSCRSCNSQKGMRTAYDFIADDKGQEGLEAYIERINDLFNKKKISRSKLNRLLVSHKAYVSRKAQGKETEEDVQLWENFIDRQL

SEQ ID NO: 4940 - protein, 177 aa, Unknown
  Description of Unknown: uncultivated organism with predicted taxonomy: Bacteroides sp. CAG:770
  MG16-224 HNH domain
ELKQSKDERNEAFKRNNQNERQNKELAERIKNYGLTPTRNRIMKLKMWEESEHSCMYCKQPVDPIEFLKGADVEREHIIPRGLLFDNSFTNQVCSCRRCNSQKGMRTAYDFIADDKGQEGLNAYIEHINDLFEKKKISRSKLNRLLVSHKAYLSRKAQGRETEEDKELWENFIDRQL

SEQ ID NO: 4941 - protein, 160 aa, Unknown
  Description of Unknown: uncultivated organism with predicted taxonomy: Bacteroidales
  MG16-225 HNH domain
ELKQSKDERAQTTERINKNERENKAIEERIREHGIRPSRARIQKYKMWEESQHQCFYCGKSISAAEFLSGADVEVEHIIPKSILFDDSFSNKVCACRDCNHTKDNLTARDFMETRGQAELDAYLARVNTAFEEGRISKTKRDHLLWHKEEIPQDFIDRQL

SEQ ID NO: 4942 - protein, 160 aa, Unknown
  Description of Unknown: uncultivated organism
  MG16-226 HNH domain
ELKQSRDERKDAFDRNNENEKRNKKISALISEQGIRPSRSRIQKYKMWEESEHRCMYCGKVVNLSEFLNGADVEIEHIIPRSILFDDSFSNKVCACRDCNREKDNMTAMDYMASKPEGEFEAYKQRVDEAFNAHRISKTKRDHLLWRRADIPQAFIDRQL

SEQ ID NO: 4943 - protein, 160 aa, Unknown
  Description of Unknown: uncultivated organism with predicted taxonomy: Bacteroidales
  MG16-228 HNH domain
ELKSSKEEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQL

SEQ ID NO: 4944 - protein, 160 aa, Unknown
  Description of Unknown: uncultivated organism with predicted taxonomy: Bacteroidales
  MG16-229 HNH domain
ELKSSKDEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQL

SEQ ID NO: 4945 - protein, 160 aa, Unknown; identical to SEQ ID NO: 4741
  Description of Unknown: uncultivated organism with predicted taxonomy: Bacteroides sp. CAG:545
  MG16-230 HNH domain

SEQ ID NO: 4946 - protein, 160 aa, Unknown; identical to SEQ ID NO: 4798
  Description of Unknown: uncultivated organism with predicted taxonomy: Bacteroides sp. CAG:770
  MG16-231 HNH domain

SEQ ID NO: 4947 - protein, 160 aa, Unknown; identical to SEQ ID NO: 4741
  Description of Unknown: uncultivated organism with predicted taxonomy: Bacteroides sp. CAG:770
  MG16-232 HNH domain

SEQ ID NO: 4948 - protein, 160 aa, Unknown; identical to SEQ ID NO: 4741
  Description of Unknown: uncultivated organism with predicted taxonomy: Bacteroides sp. CAG:545
  MG16-233 HNH domain

SEQ ID NO: 4949 - protein, 160 aa, Unknown
  Description of Unknown: uncultivated organism with predicted taxonomy: Bacteroides sp. CAG:770
  MG16-234 HNH domain
ELKLSKEGRESAAKNIRAREKANEEIAKRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQL

SEQ ID NO: 4950 - protein, 160 aa, Unknown; identical to SEQ ID NO: 4949
  Description of Unknown: uncultivated organism with predicted taxonomy: Bacteroides sp. CAG:770
  MG16-235 HNH domain

SEQ ID NO: 4951 - protein, 160 aa, Unknown; identical to SEQ ID NO: 4787
  Description of Unknown: uncultivated organism with predicted taxonomy: Bacteroides sp. CAG:770
  MG16-236 HNH domain

SEQ ID NO: 4952 - protein, 160 aa, Unknown; identical to SEQ ID NO: 4741
  Description of Unknown: uncultivated organism with predicted taxonomy: Bacteroides sp. CAG:770
  MG16-237 HNH domain

SEQ ID NO: 4953 - protein, 160 aa, Unknown; identical to SEQ ID NO: 4741
  Description of Unknown: uncultivated organism with predicted taxonomy: Bacteroides sp. CAG:545
  MG16-238 HNH domain

SEQ ID NO: 4954 - protein, 160 aa, Unknown; identical to SEQ ID NO: 4754
  Description of Unknown: uncultivated organism with predicted taxonomy: Bacteroides sp. CAG:770
  MG16-239 HNH domain

SEQ ID NO: 4955 - protein, 160 aa, Unknown; identical to SEQ ID NO: 4754
  Description of Unknown: uncultivated organism with predicted taxonomy: Bacteroides sp. CAG:709
  MG16-240 HNH domain

SEQ ID NO: 4956 - protein, 160 aa, Unknown; identical to SEQ ID NO: 4754
  Description of Unknown: uncultivated organism with predicted taxonomy: Bacteroides sp. CAG:770
  MG16-242 HNH domain

SEQ ID NO: 4957 - protein, 160 aa, Unknown
  Description of Unknown: uncultivated organism with predicted taxonomy: Bacteroides sp. CAG:709
  MG16-243 HNH domain
ELKLSKEGRAATAKNIRDREKENKEIAEKIIELGVTPSKNKILKYRLWQEAGQKCFYCGQPVGATEFLNGLDVEIEHVVPKTLLFDDSFSNKVCACRKCNAEKRNSTAYDYMKSKGENAFNDYLRRVDTAFSEHKISFTKRSRLLTPADKIPKDFISRQL

SEQ ID NO: 4958 - protein, 160 aa, Unknown
  Description of Unknown: uncultivated organism with predicted taxonomy: Bacteroidales
  MG16-245 HNH domain
ELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKDNATAMEYMAGKPTGEFEAYKQRVDEAFTEHRISKTKRDHLLWRRADIPQDFIERQL

SEQ ID NO: 4959 - protein, 177 aa, Unknown
  Description of Unknown: uncultivated organism with predicted taxonomy: Bacteroides sp. CAG:770
  MG16-246 HNH domain
ELKQSKDERNEAFKRNNQNERQNKEYAERIKEYGLTPTRNRIMKMKMWEESEYTCMYCGQPVNVTEFLQGADVEREHIIPRALLFDNSFTNQVCSCRRCNSQKGMRTAYDFIEDDKGQEGLNAYIERINDLFNRKKISRSKFNRLLVSHKAYISRKAQGKETEENKELWENFIDRQL

SEQ ID NO: 4960 - protein, 160 aa, Unknown
  Description of Unknown: uncultivated organism with predicted taxonomy: Porphyromonas sp. oral taxon 278
  MG16-247 HNH domain
ELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQL

SEQ ID NO: 4961 - protein, 160 aa, Unknown
  Description of Unknown: uncultivated organism with predicted taxonomy: Coprobacter sp.
  MG16-248 HNH domain
ELKQSREERDSAYKAINKNERDNAAIAAKIAEFGVRPSRSRIQKYKMWEESNHRCFYCGKIMDITQFLNGADVEIEHIIPRSILFDDSYSNKVCACRDCNHEKDNSTAMEYMESKPAGEFEAYKQRVDEAFSAHRISKTKRDHLLWRRGDIPQDFIERQL

SEQ ID NO: 4962 - protein, 160 aa, Unknown; identical to SEQ ID NO: 4871
  Description of Unknown: uncultivated organism with predicted taxonomy: Bacteroides sp. CAG:144
  MG16-249 HNH domain

SEQ ID NO: 4963 - protein, 177 aa, Unknown
  Description of Unknown: uncultivated organism with predicted taxonomy: Sediminibacterium sp. C3
  MG16-250 HNH domain
ELKQSKDERNETFKRNNQNERQNKEYAERIKEYGLTPTRNRIIKMKMWEESEYTCMYCGQPVNVTEFLKGADVEREHIIPRGLLFDNSFTNQVCSCRRCNSKKGMRTAYDFIADDKGQEGLNAYIDRINNLFDKKKISRSKLNRLLVSHKAYISRKAQGKETEEDKELWENFIDRQL

SEQ ID NO: 4964 - protein, 174 aa, Unknown
  Description of Unknown: uncultivated organism with predicted taxonomy: Bacteroides sp. CAG:144
  MG16-251 HNH domain
ELKQSKEEREETERGIRKQQKANDGYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQL

SEQ ID NO: 4965 - protein, 160 aa, Unknown
  Description of Unknown: uncultivated organism with predicted taxonomy: Bacteroidales
  MG16-252 HNH domain
ELKQSRDERNDAYLSINKRERENKVIEERIREYGISPSKSRIQKYRLWEESNHLCFYCGHPVGAAEFLSGSGVEIEHIIPRSLLFDDSFANKVCACRKCNAEKGNSTAFDYMKSKPANDFEDYLKRVEKYFTEKRISKTKRERLLTPASEIPQDFIDRQL

SEQ ID NO: 4966 - protein, 174 aa, Unknown
  Description of Unknown: uncultivated organism
  MG16-253 HNH domain
ELKQSKEEREETDKGIRKQQKANEEYADILKKKGVRPTRNRILKYRLWKESEEACFYCGRDIDFHEFLRFSDVEREHVIPKKLLFDDSFANQVCSCRRCNAEKGGRTALDYMRTKPNLQEYLDKVDKLFQEHKIGGKKHAHLLASYDDYLSRKKEGKETKDDIMIWEEPIDRQL

SEQ ID NO: 4967 - protein, 160 aa, Unknown
  Description of Unknown: uncultivated organism with predicted taxonomy: Marinilabiliaceae
  MG16-254 HNH domain
ELKQSRDERESAYKAMGQNERRNKEIAEKISEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPADFIERQL

SEQ ID NO: 4968 - protein, 175 aa, Unknown
  Description of Unknown: uncultivated organism with predicted taxonomy: Bacteroidetes
  MG16-255 HNH domain
ELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQL

SEQ ID NO: 4969 - protein, 174 aa, Unknown
  Description of Unknown: uncultivated organism with predicted taxonomy: Bacteroides sp. CAG:144
  MG16-256 HNH domain
ELKQSKEEREETERGIRKQQKANDEYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQL

SEQ ID NO: 4970 - protein, 160 aa, Unknown
  Description of Unknown: uncultivated organism with predicted taxonomy: Bacteroidia
  MG16-257 HNH domain
ELKQSREEREGAYRRNNQNERLNKEIFAKIEEMGIRPSRSRIQKYKMWEESNHRCMYCGKTVSLAEFLNGAEVEIEHIIPRSILFDDSFSNKVCACRECNHEKGNLTALDYLETKPTAEQEAYKQRVDEAFKEGRISKTKRDHLLWHRSDIPTDFIDRQL

SEQ ID NO: 4971 - protein, 160 aa, Unknown; identical to SEQ ID NO: 4960
  Description of Unknown: uncultivated organism with predicted taxonomy: Bacteroidales
  MG16-258 HNH domain

SEQ ID NO: 4972 - protein, 160 aa, Unknown; identical to SEQ ID NO: 4856
  Description of Unknown: uncultivated organism with predicted taxonomy: Prevotella saccharolytica
  MG16-259 HNH domain

SEQ ID NO: 4973 - protein, 175 aa, Unknown; identical to SEQ ID NO: 4968
  Description of Unknown: uncultivated organism with predicted taxonomy: Bacteroides sp. CAG:770
  MG16-260 HNH domain

SEQ ID NO: 4974 - protein, 161 aa, Unknown
  Description of Unknown: uncultivated organism with predicted taxonomy: Bacteroidales
  MG16-261 HNH domain
ELKQSKDERNTTFNNIAKRERENKGIAERIKNEYGLIPNRNKIEKFRLCEESDHKCFYCGQAVNAKEFLLGSDVEVEHVIPKSLLFDDSFANKVCACRKCNAQKGNKTAFDFMKSQSEDEFNNYVSRVEEYYKNGKISRTKHDRLLTPQTEIPSDFIERQL

SEQ ID NO: 4975 - protein, 177 aa, Unknown
  Description of Unknown: uncultivated organism with predicted taxonomy: Porphyromonas catoniae
  MG16-262 HNH domain
ELKQSKDERNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQL

SEQ ID NO: 4976 - protein, 177 aa, Unknown
  Description of Unknown: uncultivated organism with predicted taxonomy: Sediminibacterium sp. C3
  MG16-263 HNH domain
ELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWENFIDRQL

SEQ ID NO: 4977 - protein, 197 aa, Unknown
  Description of Unknown: uncultivated organism
  MG16-264 HNH domain
ELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTEFDFMRSQDKAVFDDYIKRVEKWFDDGIISPSKRERLLLSHEDYLERKKKGKTTEEDKKYWEEFVSRQA

SEQ ID NO: 4978 - protein, 177 aa, Unknown
  Description of Unknown: uncultivated organism
  MG16-265 HNH domain
ELKQSKDERNETFKRNSQNERKNKEYAERIKEYGLTPTRNRIMKMKMWEESEHSCMYCGQPVDVKEFLQGADVEREHIVPRGLLFDNSFTNQVCSCRRCNSQKGMRTAYDFIEDDKGEAGLNSYIEHINYLFDKKQISRNKFNRLLVSHKAYINRKAQGKETEEDKELWENFIDRQL

SEQ ID NO: 4979 - protein, 160 aa, Unknown; identical to SEQ ID NO: 4909
  Description of Unknown: uncultivated organism with predicted taxonomy: Porphyromonas sp. oral taxon 278
  MG16-266 HNH domain

SEQ ID NO: 4980 - protein, 177 aa, Unknown
  Description of Unknown: uncultivated organism
  MG16-267 HNH domain
HLNKNKYQRNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQL

SEQ ID NO: 4981 - protein, 174 aa, Unknown
  Description of Unknown: uncultivated organism with predicted taxonomy: Prevotella
  MG16-268 HNH domain
ELKMDRESRHRKFTQNNSRKRQNEEYADKINEHGIIPTRNRVIKYRLWEEANMQCFYCGQPINITELLRDPTIEKEHIIPKALLLDNSYSNLVCSCRKCNQEKGARTAYDYMRQKSDLDAYIKRINKLAETQKISQTKRLHLLASYEDYLVRKRLGKATEEDRNLWEEFINRQL

SEQ ID NO: 4982 - protein, 177 aa, Unknown; identical to SEQ ID NO: 4932
  Description of Unknown: uncultivated organism with predicted taxonomy: Bacteroidales
  MG16-269 HNH domain

SEQ ID NO: 4983 - protein, 160 aa, Unknown
  Description of Unknown: uncultivated organism with predicted taxonomy: Bacteroidales
  MG16-270 HNH domain
ELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKGNSTAMEYMEGKPTGEFEAYKQRVDEAFTEHRISKTKRDHLLWRRADIPQDFIERQL

SEQ ID NO: 4984 - protein, 160 aa, Unknown
  Description of Unknown: uncultivated organism with predicted taxonomy: Bacteroidales
  MG16-271 HNH domain
ELKQNKEERETTYKNNSKNERLNREITERIKEMGIRPSRMRVQKYKLWEESLHQCFYCGKTVGAAEFLSGADVEIEHIIPRSVLFDDSYSNKVCACRECNHAKNNQTAFDFMKAQSTDKFEAYKSRVDDAFKEKRISKTKRDHLLWGLEDIPQDFIDRQL

SEQ ID NO: 4985 - protein, 177 aa, Unknown
  Description of Unknown: uncultivated organism with predicted taxonomy: Bacteroides sp. CAG:770
  MG16-272 HNH domain
ELKQSKDERNEAFKRNNQNERQNKDYAERIKEYGLTPTRNRIMKMRMWEESEYTCMYCGQPVNVTEFLKGADVEREHIIPRGLLFDNSFTNQVCSCRRCNSKKGMRTAYDFIADEKGQEGLDTYIDRINDLFNRKKISRSKLNRLFVSYKAYMSRKAQGKETDEDKDLWENFIDRQL

SEQ ID NO: 4986 - protein, 177 aa, Unknown
  Description of Unknown: uncultivated organism with predicted taxonomy: Bacteroidetes
  MG16-273 HNH domain
ELKQSKDERNETFKRNNQNERQNKEYAERIKKYGLTPTRNRIMKLKMWEESEHACMYCEQPVDPIEFLKGADVEREHIIPRGLLFDNSFTNQVCSCRRCNSKKGMRTAYDFIADDKGQEGLNAYIEHINDLFDKKKISRSKLNRLLVSHKAYISRKAQGKETEEDKELWENFIDRQL

SEQ ID NO: 4987 - protein, 174 aa, Unknown
  Description of Unknown: uncultivated organism with predicted taxonomy: Bacteroidales
  MG16-274 HNH domain
ELKQSKEEREETDKGIRKQQKANEEYADILKKKGVRPTRNRILKYRLWKESEEACFYCGRDIDFHEFLRFSDIEREHVIPKKLLFDDSFANQVCSCRRCNAEKGGRTALDYMRTKPNLQEYLDKVDKMFQEHKIGGKKHTHLLASYDDYLSRKKEGKETKDDILIWEEPIDRQL

SEQ ID NO: 4988 - protein, 197 aa, Unknown
  Description of Unknown: uncultivated organism with predicted taxonomy: Bacteroidetes
  MG16-275 HNH domain
ELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTAFDFMRSQDKAMFDDYIKRVEKWFDDGIISPSKRERLLLSHEDYMERKKKGKTTEEDKKYWEEFVSRQA

SEQ ID NO: 4989 - protein, 162 aa, Unknown
  Description of Unknown: uncultivated organism with predicted taxonomy: Clostridiales
  MG18-1 HNH domain
GVSPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQTMRQTALWKALLEKGLISKQKYLRLTRTTPFTEEELAGFINRQL

SEQ ID NO: 4990 - protein, 168 aa, Unknown
  Description of Unknown: uncultivated organism with predicted taxonomy: Phascolarctobacterium succinatutens
  MG18-3 HNH domain
SKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 4991 - protein, 168 aa, Unknown
  Description of Unknown: uncultivated organism with predicted taxonomy: Phascolarctobacterium succinatutens
  MG18-4 HNH domain
SKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQL

SEQ ID NO: 4992 - protein, 168 aa, Unknown
  Description of Unknown: uncultivated organism with predicted taxonomy: Phascolarctobacterium succinatutens
  MG18-5 HNH domain
SKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 4993 - protein, 168 aa, Unknown; identical to SEQ ID NO: 4990
  Description of Unknown: uncultivated organism with predicted taxonomy: Phascolarctobacterium
  MG18-6 HNH domain

SEQ ID NO: 4994 - protein, 168 aa, Unknown
  Description of Unknown: uncultivated organism with predicted taxonomy: Acidaminococcales
  MG18-7 HNH domain
SKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQL

SEQ ID NO: 4995 - protein, 168 aa, Unknown
  Description of Unknown: uncultivated organism
  MG18-8 HNH domain
SKEESKRTDSRLKKLQDLYKKCKEENIDFVPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 4996 - protein, 168 aa, Unknown
  Description of Unknown: uncultivated organism with predicted taxonomy: Phascolarctobacterium succinatutens
  MG18-9 HNH domain
SKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 4997 - protein, 168 aa, Unknown; identical to SEQ ID NO: 4996
  Description of Unknown: uncultivated organism with predicted taxonomy: Phascolarctobacterium
  MG18-10 HNH domain

SEQ ID NO: 4998 - protein, 168 aa, Unknown
  Description of Unknown: uncultivated organism with predicted taxonomy: Phascolarctobacterium succinatutens
  MG18-11 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 4999 - protein, 168 aa, Unknown
  Description of Unknown: uncultivated organism with predicted taxonomy: Phascolarctobacterium succinatutens
  MG18-12 HNH domain
SKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5000 - protein, 168 aa, Unknown; identical to SEQ ID NO: 4991
  Description of Unknown: uncultivated organism with predicted taxonomy: Phascolarctobacterium succinatutens
  MG18-13 HNH domain

SEQ ID NO: 5001 - protein, 168 aa, Unknown; identical to SEQ ID NO: 4996
  Description of Unknown: uncultivated organism with predicted taxonomy: Phascolarctobacterium
  MG18-14 HNH domain

SEQ ID NO: 5002 - protein, 168 aa, Unknown
  Description of Unknown: uncultivated organism with predicted taxonomy: Phascolarctobacterium succinatutens
  MG18-15 HNH domain
SKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQL

SEQ ID NO: 5003 - protein, 168 aa, Unknown; identical to SEQ ID NO: 4999
  Description of Unknown: uncultivated organism with predicted taxonomy: Phascolarctobacterium succinatutens
  MG18-16 HNH domain

SEQ ID NO: 5004 - protein, 168 aa, Unknown; identical to SEQ ID NO: 4996
  Description of Unknown: uncultivated organism with predicted taxonomy: Phascolarctobacterium
  MG18-17 HNH domain

SEQ ID NO: 5005 - protein, 168 aa, Unknown; identical to SEQ ID NO: 4996
  Description of Unknown: uncultivated organism with predicted taxonomy: Phascolarctobacterium succinatutens
  MG18-18 HNH domain

SEQ ID NO: 5006 - protein, 168 aa, Unknown; identical to SEQ ID NO: 4996
  Description of Unknown: uncultivated organism with predicted taxonomy: Phascolarctobacterium
  MG18-19 HNH domain

SEQ ID NO: 5007 - protein, 168 aa, Unknown; identical to SEQ ID NO: 4996
  Description of Unknown: uncultivated organism with predicted taxonomy: Phascolarctobacterium
  MG18-20 HNH domain

SEQ ID NO: 5008 - protein, 168 aa, Unknown; identical to SEQ ID NO: 4996
  Description of Unknown: uncultivated organism with predicted taxonomy: Phascolarctobacterium
  MG18-21 HNH domain

SEQ ID NO: 5009 - protein, 168 aa, Unknown; identical to SEQ ID NO: 4991
  Description of Unknown: uncultivated organism with predicted taxonomy: Phascolarctobacterium
  MG18-22 HNH domain

SEQ ID NO: 5010 - protein, 168 aa, Unknown
  Description of Unknown: uncultivated organism with predicted taxonomy: Phascolarctobacterium succinatutens
  MG18-23 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQL

SEQ ID NO: 5011 - protein, 168 aa, Unknown
  Description of Unknown: uncultivated organism with predicted taxonomy: Phascolarctobacterium
  MG18-24 HNH domain
SKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5012 - protein, 168 aa, Unknown; identical to SEQ ID NO: 4996
  Description of Unknown: uncultivated organism with predicted taxonomy: Phascolarctobacterium succinatutens
  MG18-25 HNH domain

SEQ ID NO: 5013 - protein, 168 aa, Unknown; identical to SEQ ID NO: 4996
  Description of Unknown: uncultivated organism with predicted taxonomy: Phascolarctobacterium succinatutens
  MG18-26 HNH domain

SEQ ID NO: 5014 - protein, 168 aa, Unknown; identical to SEQ ID NO: 5011
  Description of Unknown: uncultivated organism with predicted taxonomy: Phascolarctobacterium succinatutens
  MG18-27 HNH domain

SEQ ID NO: 5015 - protein, 168 aa, Unknown
  Description of Unknown: uncultivated organism with predicted taxonomy: Phascolarctobacterium
  MG18-28 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5016 - protein, 168 aa, Unknown
  Description of Unknown: uncultivated organism with predicted taxonomy: Phascolarctobacterium succinatutens
  MG18-29 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 5017 - protein, 168 aa, Unknown
  Description of Unknown: uncultivated organism with predicted taxonomy: Phascolarctobacterium succinatutens
  MG18-30 HNH domain
SKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQL

SEQ ID NO: 5018 - protein, 168 aa, Unknown; identical to SEQ ID NO: 5017
  Description of Unknown: uncultivated organism with predicted taxonomy: Phascolarctobacterium succinatutens
  MG18-31 HNH domain

SEQ ID NO: 5019 - protein, 168 aa, Unknown
  Description of Unknown: uncultivated organism with predicted taxonomy: Phascolarctobacterium succinatutens
  MG18-32 HNH domain
SKEESKRTDSRLKKLQDLYKQCREENIDFMPRKDEFNTLKTQLSSKKEDDLRIDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5020 - protein, 168 aa, Unknown; identical to SEQ ID NO: 4996
  Description of Unknown: uncultivated organism with predicted taxonomy: Phascolarctobacterium succinatutens
  MG18-33 HNH domain

SEQ ID NO: 5021 - protein, 168 aa, Unknown; identical to SEQ ID NO: 4996
  Description of Unknown: uncultivated organism with predicted taxonomy: Phascolarctobacterium succinatutens
  MG18-34 HNH domain

SEQ ID NO: 5022 - protein, 168 aa, Unknown; identical to SEQ ID NO: 4999
  Description of Unknown: uncultivated organism with predicted taxonomy: Phascolarctobacterium succinatutens
  MG18-35 HNH domain

SEQ ID NO: 5023 - protein, 168 aa, Unknown; identical to SEQ ID NO: 4996
  Description of Unknown: uncultivated organism with predicted taxonomy: Phascolarctobacterium succinatutens
  MG18-36 HNH domain

SEQ ID NO: 5024 - protein, 168 aa, Unknown; identical to SEQ ID NO: 5011
  Description of Unknown: uncultivated organism with predicted taxonomy: Phascolarctobacterium succinatutens
  MG18-37 HNH domain

SEQ ID NO: 5025 - protein, 168 aa, Unknown; identical to SEQ ID NO: 5017
  Description of Unknown: uncultivated organism with predicted taxonomy: Phascolarctobacterium
  MG18-38 HNH domain

SEQ ID NO: 5026 - protein, 168 aa, Unknown
  Description of Unknown: uncultivated organism with predicted taxonomy: Phascolarctobacterium
  MG18-39 HNH domain
SKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 5027 - protein, 168 aa, Unknown; identical to SEQ ID NO: 5016
  Description of Unknown: uncultivated organism with predicted taxonomy: Phascolarctobacterium succinatutens
  MG18-40 HNH domain

SEQ ID NO: 5028 - protein, 168 aa, Unknown
  Description of Unknown: uncultivated organism with predicted taxonomy: Phascolarctobacterium succinatutens
  MG18-41 HNH domain
SKEESKRTDSRLKKLQDLYKKCREENIDFMPRKDEFNALKIQLNSKKDYDLRSDKLYLYYTQMGRCMYTGERIELASLYDDNLYDIDHIYPRSKTKDDSLSNRVLVKKEVNAAKTDIYPLDAAIRTKMHSFWKLLYDKGLIDERKYERLTRSTQLRDEELAGFISRQL

SEQ ID NO: 5029 - protein, 168 aa, Unknown; identical to SEQ ID NO: 4990
  Description of Unknown: uncultivated organism with predicted taxonomy: Phascolarctobacterium succinatutens
  MG18-42 HNH domain

SEQ ID NO: 5030 - protein, 168 aa, Unknown; identical to SEQ ID NO: 4999
  Description of Unknown: uncultivated organism with predicted taxonomy: Phascolarctobacterium succinatutens
  MG18-43 HNH domain

SEQ ID NO: 5031 - protein, 168 aa, Unknown; identical to SEQ ID NO: 5002
  Description of Unknown: uncultivated organism with predicted taxonomy: Phascolarctobacterium succinatutens
  MG18-44 HNH domain

SEQ ID NO: 5032 - protein, 168 aa, Unknown; identical to SEQ ID NO: 5011
  Description of Unknown: uncultivated organism with predicted taxonomy: Phascolarctobacterium succinatutens
  MG18-45 HNH domain

SEQ ID NO: 5033 - protein, 168 aa, Unknown
  Description of Unknown: uncultivated organism with predicted taxonomy: Phascolarctobacterium
  MG18-46 HNH domain
SKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5034 - protein, 168 aa, Unknown; identical to SEQ ID NO: 4994
  Description of Unknown: uncultivated organism with predicted taxonomy: Phascolarctobacterium
  MG18-47 HNH domain

SEQ ID NO: 5035 - protein, 168 aa, Unknown
  Description of Unknown: uncultivated organism with predicted taxonomy: Phascolarctobacterium succinatutens
  MG18-48 HNH domain
SKEESKRTDSRLKKLQDLYKKCREENIDFMPRKDEFNALKTQLSSKKEENLRSDKLYLYYTQMGRCMYTGERIELASLDDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5036 - protein, 168 aa, Unknown; identical to SEQ ID NO: 5016
  Description of Unknown: uncultivated organism with predicted taxonomy: Phascolarctobacterium succinatutens
  MG18-49 HNH domain

SEQ ID NO: 5037 - protein, 168 aa, Unknown; identical to SEQ ID NO: 4996
  Description of Unknown: uncultivated organism with predicted taxonomy: Phascolarctobacterium succinatutens
  MG18-50 HNH domain

SEQ ID NO: 5038 - protein, 168 aa, Unknown
  Description of Unknown: uncultivated organism with predicted taxonomy: Phascolarctobacterium succinatutens
  MG18-51 HNH domain
SKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5039 - protein, 168 aa, Unknown; identical to SEQ ID NO: 5011
  Description of Unknown: uncultivated organism with predicted taxonomy: Phascolarctobacterium succinatutens
  MG18-52 HNH domain

SEQ ID NO: 5040 - protein, 168 aa, Unknown
  Description of Unknown: uncultivated organism with predicted taxonomy: Firmicutes
  MG18-53 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRNTQLGDEELAGFISRQL

SEQ ID NO: 5041 - protein, 168 aa, Unknown
  Description of Unknown: uncultivated organism with predicted taxonomy: Phascolarctobacterium
  MG18-54 HNH domain
SKEESKRTDSRLKKLQDLYKQCKEENIDFMPHTDELNAFKIQLSSKKEDDLRSDKLYLYYTQMGRCMYTGERIEIASLYDDNLYDIDHIYPRSKTKDDSLSNRVLVKKEVNAAKTDIYPLDAAIRTKMHTFWKLLYDKGFIDERKYERLIRSKQLRDEELAGFISRQL

SEQ ID NO: 5042 - protein, 168 aa, Unknown; identical to SEQ ID NO: 5026
  Description of Unknown: uncultivated organism with predicted taxonomy: Phascolarctobacterium
  MG18-55 HNH domain

SEQ ID NO: 5043 - protein, 168 aa, Unknown; identical to SEQ ID NO: 4996
  Description of Unknown: uncultivated organism with predicted taxonomy: Phascolarctobacterium succinatutens
  MG18-56 HNH domain

SEQ ID NO: 5044 - protein, 168 aa, Unknown
  Description of Unknown: uncultivated organism with predicted taxonomy: Phascolarctobacterium succinatutens
  MG18-57 HNH domain
SKEESKRTDSRLKKLHDLYKKCREENIDFMPRKDEFNALKTQLSSKKEENLRSDKLYLYYTQMGRCMYTGERIELASLHDNNLYDIDHIYPRSKTKDDSLSNRVLVKKQINAAKTDTYPLDAAIRTKMHSFWKLLYDKGFIDERKYERLTRSTQLRDEELAGFISRQL

SEQ ID NO: 5045 - protein, 168 aa, Unknown
  Description of Unknown: uncultivated organism with predicted taxonomy: Phascolarctobacterium succinatutens
  MG18-58 HNH domain
SKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5046 - protein, 168 aa, Unknown; identical to SEQ ID NO: 5040
  Description of Unknown: uncultivated organism with predicted taxonomy: Phascolarctobacterium succinatutens
  MG18-59 HNH domain

SEQ ID NO: 5047 - protein, 168 aa, Unknown; identical to SEQ ID NO: 5016
  Description of Unknown: uncultivated organism
  MG18-60 HNH domain

SEQ ID NO: 5048 - protein, 168 aa, Unknown; identical to SEQ ID NO: 5011
  Description of Unknown: uncultivated organism with predicted taxonomy: Phascolarctobacterium succinatutens
  MG18-61 HNH domain

SEQ ID NO: 5049 - protein, 168 aa, Unknown
  Description of Unknown: uncultivated organism with predicted taxonomy: Phascolarctobacterium succinatutens
  MG18-62 HNH domain
SKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5050 - protein, 168 aa, Unknown; identical to SEQ ID NO: 5011
  Description of Unknown: uncultivated organism
  MG18-63 HNH domain

SEQ ID NO: 5051 - protein, 168 aa, Unknown
  Description of Unknown: uncultivated organism with predicted taxonomy: Phascolarctobacterium succinatutens
  MG18-64 HNH domain
SKEESKRTDSRLKKLQYLYKKCREENIDFMPRKDEFNALKTQLSSKKEEDLRSDKLYLYYTQMGRCMYTGESIELASLYDNNLYDIDHIYPRSKTKDDSLSNRVLVQKQVNAAKTDIYPLDAAIRTKMHSFWNLLYDKGFIDERKYERLMRSTQLRDEELAGFISRQL

SEQ ID NO: 5052 - protein, 168 aa, Unknown; identical to SEQ ID NO: 5016
  Description of Unknown: uncultivated organism with predicted taxonomy: Firmicutes
  MG18-65 HNH domain

SEQ ID NO: 5053 - protein, 168 aa, Unknown; identical to SEQ ID NO: 5011
  Description of Unknown: uncultivated organism with predicted taxonomy: Phascolarctobacterium succinatutens
  MG18-66 HNH domain

SEQ ID NO: 5054 - protein, 168 aa, Unknown; identical to SEQ ID NO: 4998
  Description of Unknown: uncultivated organism
  MG18-67 HNH domain

SEQ ID NO: 5055 - protein, 168 aa, Unknown; identical to SEQ ID NO: 5016
  Description of Unknown: uncultivated organism with predicted taxonomy: Phascolarctobacterium succinatutens
  MG18-68 HNH domain

SEQ ID NO: 5056 - protein, 168 aa, Unknown
  Description of Unknown: uncultivated organism with predicted taxonomy: Phascolarctobacterium succinatutens
  MG18-69 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQL

SEQ ID NO: 5057 - protein, 168 aa, Unknown; identical to SEQ ID NO: 4995
  Description of Unknown: uncultivated organism with predicted taxonomy: Negativicutes
  MG18-70 HNH domain

SEQ ID NO: 5058 - protein, 168 aa, Unknown; identical to SEQ ID NO: 5016
  Description of Unknown: uncultivated organism with predicted taxonomy: Phascolarctobacterium succinatutens
  MG18-71 HNH domain

SEQ ID NO: 5059 - protein, 168 aa, Unknown
  Description of Unknown: uncultivated organism with predicted taxonomy: Phascolarctobacterium succinatutens
  MG18-72 HNH domain
SKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5060 - protein, 168 aa, Unknown; identical to SEQ ID NO: 5038
  Description of Unknown: uncultivated organism with predicted taxonomy: Phascolarctobacterium
  MG18-73 HNH domain

SEQ ID NO: 5061 - protein, 168 aa, Unknown; identical to SEQ ID NO: 5026
  Description of Unknown: uncultivated organism with predicted taxonomy: Phascolarctobacterium succinatutens
  MG18-74 HNH domain

SEQ ID NO: 5062 - protein, 168 aa, Unknown; identical to SEQ ID NO: 4990
  Description of Unknown: uncultivated organism with predicted taxonomy: Phascolarctobacterium
  MG18-75 HNH domain

SEQ ID NO: 5063 - protein, 168 aa, Unknown; identical to SEQ ID NO: 4992
  Description of Unknown: uncultivated organism with predicted taxonomy: Phascolarctobacterium succinatutens
  MG18-76 HNH domain

SEQ ID NO: 5064 - protein, 20 aa, Unknown
  Description of Unknown: uncultivated organism with predicted taxonomy: Clostridiales
  MG18-77 HNH domain
SKEESKRTDSRLKKLQGRKY

SEQ ID NO: 5065 - protein, 168 aa, Unknown; identical to SEQ ID NO: 5011
  Description of Unknown: uncultivated organism with predicted taxonomy: Phascolarctobacterium
  MG18-78 HNH domain

SEQ ID NO: 5066 - protein, 168 aa, Unknown
  Description of Unknown: uncultivated organism with predicted taxonomy: Phascolarctobacterium succinatutens
  MG18-79 HNH domain
SKEESKRTDSRLKKLQDLYKKRREENIDFMPRKDEFNALKTQLSSKKEENLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5067 - protein, 168 aa, Unknown; identical to SEQ ID NO: 5010
  Description of Unknown: uncultivated organism with predicted taxonomy: Phascolarctobacterium succinatutens
  MG18-80 HNH domain

SEQ ID NO: 5068 - protein, 168 aa, Unknown; identical to SEQ ID NO: 4994
  Description of Unknown: uncultivated organism with predicted taxonomy: Phascolarctobacterium succinatutens
  MG18-81 HNH domain

SEQ ID NO: 5069 - protein, 168 aa, Unknown; identical to SEQ ID NO: 4999
  Description of Unknown: uncultivated organism with predicted taxonomy: Phascolarctobacterium succinatutens
  MG18-82 HNH domain

SEQ ID NO: 5070 - protein, 168 aa, Unknown; identical to SEQ ID NO: 5015
  Description of Unknown: uncultivated organism with predicted taxonomy: Phascolarctobacterium succinatutens
  MG18-83 HNH domain

SEQ ID NO: 5071 - protein, 168 aa, Unknown
  Description of Unknown: uncultivated organism with predicted taxonomy: Phascolarctobacterium succinatutens
  MG18-84 HNH domain
SKEESKRTDSRLKKLQDLYKKCKEENIDFMPRKDEFNALKTQLSSKKEDDLRIDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQL

SEQ ID NO: 5072 - protein, 168 aa, Unknown; identical to SEQ ID NO: 5010
  Description of Unknown: uncultivated organism with predicted taxonomy: Phascolarctobacterium
  MG18-85 HNH domain

SEQ ID NO: 5073 - protein, 168 aa, Unknown; identical to SEQ ID NO: 4996
  Description of Unknown: uncultivated organism with predicted taxonomy: Phascolarctobacterium succinatutens
  MG18-86 HNH domain

SEQ ID NO: 5074 - protein, 168 aa, Unknown
  Description of Unknown: uncultivated organism with predicted taxonomy: Phascolarctobacterium succinatutens
  MG18-87 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5075 - protein, 168 aa, Unknown; identical to SEQ ID NO: 4990
  Description of Unknown: uncultivated organism with predicted taxonomy: Phascolarctobacterium
  MG18-88 HNH domain

SEQ ID NO: 5076 - protein, 168 aa, Unknown
  Description of Unknown: uncultivated organism with predicted taxonomy: Firmicutes
  MG18-89 HNH domain
SKEESKRTDSRLKKLQDLYKKCREENIDFMPRKDEFNVLKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQL

SEQ ID NO: 5077 - protein, 168 aa, Unknown; identical to SEQ ID NO: 5026
  Description of Unknown: uncultivated organism with predicted taxonomy: Phascolarctobacterium
  MG18-90 HNH domain

SEQ ID NO: 5078 - protein, 168 aa, Unknown; identical to SEQ ID NO: 5015
  Description of Unknown: uncultivated organism with predicted taxonomy: Phascolarctobacterium succinatutens
  MG18-91 HNH domain

SEQ ID NO: 5079 - protein, 168 aa, Unknown; identical to SEQ ID NO: 5056
  Description of Unknown: uncultivated organism with predicted taxonomy: Phascolarctobacterium succinatutens
  MG18-92 HNH domain

SEQ ID NO: 5080 - protein, 168 aa, Unknown; identical to SEQ ID NO: 4999
  Description of Unknown: uncultivated organism
  MG18-93 HNH domain

SEQ ID NO: 5081 - protein, 168 aa, Unknown; identical to SEQ ID NO: 5016
  Description of Unknown: uncultivated organism with predicted taxonomy: Phascolarctobacterium succinatutens
  MG18-94 HNH domain

SEQ ID NO: 5082 - protein, 168 aa, Unknown; identical to SEQ ID NO: 5016
  Description of Unknown: uncultivated organism
  MG18-95 HNH domain

SEQ ID NO: 5083 - protein, 168 aa, Unknown; identical to SEQ ID NO: 5056
  Description of Unknown: uncultivated organism with predicted taxonomy: Clostridium sp. CAG:964
  MG18-96 HNH domain

SEQ ID NO: 5084 - protein, 168 aa, Unknown; identical to SEQ ID NO: 5011
  Description of Unknown: uncultivated organism with predicted taxonomy: Phascolarctobacterium succinatutens
  MG18-97 HNH domain

SEQ ID NO: 5085 - protein, 168 aa, Unknown; identical to SEQ ID NO: 5015
  Description of Unknown: uncultivated organism with predicted taxonomy: Phascolarctobacterium succinatutens
  MG18-98 HNH domain

SEQ ID NO: 5086 - protein, 168 aa, Unknown; identical to SEQ ID NO: 4992
  Description of Unknown: uncultivated organism with predicted taxonomy: Firmicutes
  MG18-99 HNH domain

SEQ ID NO: 5087 - protein, 168 aa, Unknown; identical to SEQ ID NO: 4998
  Description of Unknown: uncultivated organism with predicted taxonomy: Phascolarctobacterium succinatutens
  MG18-100 HNH domain

SEQ ID NO: 5088 - protein, 168 aa, Unknown
  Description of Unknown: uncultivated organism with predicted taxonomy: Firmicutes
  MG18-101 HNH domain
SKEESKRTDSRLKKLQDLYKKCKEENIDFMPRKDEFNALKTQLSSKKEDDLRSDKLYLYYTQMGCCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQL

SEQ ID NO: 5089 - protein, 168 aa, Unknown
  Description of Unknown: uncultivated organism with predicted taxonomy: Firmicutes
  MG18-102 HNH domain
SKEESKRTDSRLKKLQDLYKKCREENIDFMPRKDEFNALKTQLSSKKEDDLRSDKLYLYYTQMGRCMYTGESIELASLYDNNLYDIDHIYPRSKTKDDSLSNRVLVKKQVNAAKTDIYPLDAAIRTKMHSFWKLLYDKGFIDERKYERLMRSTQLRDEELAGFISRQL

SEQ ID NO: 5090 - protein, 168 aa, Unknown
  Description of Unknown: uncultivated organism with predicted taxonomy: Phascolarctobacterium succinatutens
  MG18-103 HNH domain
SKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5091 - protein, 168 aa, Unknown; identical to SEQ ID NO: 4998
  Description of Unknown: uncultivated organism with predicted taxonomy: Phascolarctobacterium
  MG18-104 HNH domain

SEQ ID NO: 5092 - protein, 168 aa, Unknown; identical to SEQ ID NO: 4998
  Description of Unknown: uncultivated organism with predicted taxonomy: Phascolarctobacterium succinatutens
  MG18-105 HNH domain

SEQ ID NO: 5093 - protein, 168 aa, Unknown; identical to SEQ ID NO: 4996
  Description of Unknown: uncultivated organism with predicted taxonomy: Firmicutes
  MG18-106 HNH domain

SEQ ID NO: 5094 - protein, 168 aa, Unknown
  Description of Unknown: uncultivated organism with predicted taxonomy: Phascolarctobacterium succinatutens
  MG18-107 HNH domain
SKEESKRTDSRLKKLQDLYKKCREENIDFMPRKDEFNAFKTQLSSKKEEDLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5095 - protein, 168 aa, Unknown; identical to SEQ ID NO: 4991
  Description of Unknown: uncultivated organism with predicted taxonomy: Ruminococcaceae bacterium
  MG18-108 HNH domain

SEQ ID NO: 5096 - protein, 168 aa, Unknown
  Description of Unknown: uncultivated organism with predicted taxonomy: Phascolarctobacterium succinatutens
  MG18-109 HNH domain
SKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELVGFISRQL

SEQ ID NO: 5097 - protein, 75 aa, Unknown
  Description of Unknown: uncultivated organism with predicted taxonomy: Clostridiales bacterium
  MG18-110 HNH domain
SKEESKRTDSRLKKLQDLYKKCREENIDFMPRKDEFNALKTQLSSKKEENLRSDKLYLYYTQMGRCMYTGERLSL

SEQ ID NO: 5098 - protein, 168 aa, Unknown; identical to SEQ ID NO: 4992
  Description of Unknown: uncultivated organism with predicted taxonomy: Phascolarctobacterium succinatutens
  MG18-111 HNH domain

SEQ ID NO: 5099 - protein, 168 aa, Unknown; identical to SEQ ID NO: 5074
  Description of Unknown: uncultivated organism with predicted taxonomy: Phascolarctobacterium succinatutens
  MG18-112 HNH domain

SEQ ID NO: 5100 - protein, 168 aa, Unknown
  Description of Unknown: uncultivated organism with predicted taxonomy: Clostridiales
  MG18-113 HNH domain
SKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5101 - protein, 168 aa, Unknown
  Description of Unknown: uncultivated organism with predicted taxonomy: Phascolarctobacterium
  MG18-114 HNH domain
SKEESKRTDSRLKKLQDLYKKCREENIDFMPRKDEFNVLKTQLSSKNEEDLRSDKLYLYYTQMGRCMYTGEIIELASLNDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5102 - protein, 168 aa, Unknown; identical to SEQ ID NO: 5038
  Description of Unknown: uncultivated organism with predicted taxonomy: Phascolarctobacterium succinatutens
  MG18-115 HNH domain

SEQ ID NO: 5103 - protein, 168 aa, Unknown; identical to SEQ ID NO: 5015
  Description of Unknown: uncultivated organism with predicted taxonomy: Phascolarctobacterium succinatutens
  MG18-116 HNH domain

SEQ ID NO: 5104 - protein, 168 aa, Unknown; identical to SEQ ID NO: 5011
  Description of Unknown: uncultivated organism with predicted taxonomy: Phascolarctobacterium
  MG18-117 HNH domain

SEQ ID NO: 5105 - protein, 168 aa, Unknown
  Description of Unknown: uncultivated organism with predicted taxonomy: Phascolarctobacterium succinatutens
  MG18-118 HNH domain
SKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKILYDKGFIDERKYQRLTRSTQLRDEELAGFISRQL

SEQ ID NO: 5106 - protein, 168 aa, Unknown; identical to SEQ ID NO: 5016
  Description of Unknown: uncultivated organism with predicted taxonomy: Phascolarctobacterium succinatutens
  MG18-119 HNH domain

SEQ ID NO: 5107 - protein, 168 aa, Unknown; identical to SEQ ID NO: 5056
  Description of Unknown: uncultivated organism with predicted taxonomy: Phascolarctobacterium succinatutens
  MG18-120 HNH domain

SEQ ID NO: 5108 - protein, 168 aa, Unknown; identical to SEQ ID NO: 5038
  Description of Unknown: uncultivated organism with predicted taxonomy: Phascolarctobacterium succinatutens
  MG18-121 HNH domain

SEQ ID NO: 5109 - protein, 168 aa, Unknown
  Description of Unknown: uncultivated organism with predicted taxonomy: Phascolarctobacterium
  MG18-122 HNH domain
SKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQL

SEQ ID NO: 5110 - protein, 168 aa, Unknown; identical to SEQ ID NO: 5011
  Description of Unknown: uncultivated organism with predicted taxonomy: Phascolarctobacterium succinatutens
  MG18-123 HNH domain

SEQ ID NO: 5111 - protein, 168 aa, Unknown
  Description of Unknown: uncultivated organism with predicted taxonomy: Phascolarctobacterium succinatutens
  MG18-124 HNH domain
SKEESKRTDSRLKKLQDLYKKCREENIDFMPRKDEFNALKTMLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5112 - protein, 168 aa, Unknown; identical to SEQ ID NO: 5026
  Description of Unknown: uncultivated organism with predicted taxonomy: Phascolarctobacterium
  MG18-125 HNH domain

SEQ ID NO: 5113 - protein, 168 aa, Unknown; identical to SEQ ID NO: 5100
  Description of Unknown: uncultivated organism with predicted taxonomy: Phascolarctobacterium
  MG18-126 HNH domain

SEQ ID NO: 5114 - protein, 168 aa, Unknown; identical to SEQ ID NO: 5071
  Description of Unknown: uncultivated organism with predicted taxonomy: Phascolarctobacterium
  MG18-127 HNH domain

SEQ ID NO: 5115 - protein, 168 aa, Unknown
  Description of Unknown: uncultivated organism with predicted taxonomy: Phascolarctobacterium
  MG18-128 HNH domain
SKEESKRTDSRLKKLQDLYKQCREENIDFMPHTDELNAFKIQLSSKKEDDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5116 - protein, 168 aa, Unknown
  Description of Unknown: uncultivated organism with predicted taxonomy: Phascolarctobacterium succinatutens
  MG18-129 HNH domain
SKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQL

SEQ ID NO: 5117 - protein, 168 aa, Unknown
  Description of Unknown: uncultivated organism with predicted taxonomy: Phascolarctobacterium succinatutens
  MG18-130 HNH domain
SKEESKRTDSRLKKLQDLYKKCREENIDFMPRKDEFNTLKTQLNSKKEDDLRRDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQL

SEQ ID NO: 5118 - protein, 168 aa, Unknown; identical to SEQ ID NO: 5015
  Description of Unknown: uncultivated organism with predicted taxonomy: Phascolarctobacterium succinatutens
  MG18-131 HNH domain

SEQ ID NO: 5119 - protein, 168 aa, Unknown; identical to SEQ ID NO: 5056
  Description of Unknown: uncultivated organism with predicted taxonomy: Phascolarctobacterium succinatutens
  MG18-132 HNH domain

SEQ ID NO: 5120 - protein, 168 aa, Unknown; identical to SEQ ID NO: 5109
  Description of Unknown: uncultivated organism with predicted taxonomy: Phascolarctobacterium succinatutens
  MG18-133 HNH domain

SEQ ID NO: 5121 - protein, 162 aa, Unknown
  Description of Unknown: uncultivated organism with predicted taxonomy: Clostridiales
  MG18-135 HNH domain
GASPEQKNKRTVSRKDQLLALYKACKEDARDWCSELEALPEDKLRSDKLYLYYTQMGRCMYSGELIRLDDLMHDTANQLYDIDHIYPQSKTKDDSLTNRVLVKRQLNAIKSNDYPLPQAMRQTALWKALLEKGLISKQKYLRLTRTTPFTGEELAGFINRQL

SEQ ID NO: 5122 - protein, 162 aa, Unknown
  Description of Unknown: uncultivated organism with predicted taxonomy: Clostridiales
  MG18-136 HNH domain
GASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQL

SEQ ID NO: 5123 - protein, 162 aa, Unknown; identical to SEQ ID NO: 5122
  Description of Unknown: uncultivated organism with predicted taxonomy: Dorea sp. OM02-2LB
  MG18-137 HNH domain

SEQ ID NO: 5124 - protein, 168 aa, Unknown
  Description of Unknown: uncultivated organism with predicted taxonomy: Phascolarctobacterium
  MG18-138 HNH domain
SKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5125 - protein, 168 aa, Unknown
  Description of Unknown: uncultivated organism with predicted taxonomy: Phascolarctobacterium succinatutens
  MG18-139 HNH domain
SKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQL

SEQ ID NO: 5126 - protein, 168 aa, Unknown; identical to SEQ ID NO: 5125
  Description of Unknown: uncultivated organism with predicted taxonomy: Phascolarctobacterium succinatutens
  MG18-140 HNH domain

SEQ ID NO: 5127 - protein, 168 aa, Unknown
  Description of Unknown: uncultivated organism with predicted taxonomy: Firmicutes
  MG18-141 HNH domain
SKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQL

SEQ ID NO: 5128 - protein, 168 aa, Unknown; identical to SEQ ID NO: 5056
  Description of Unknown: uncultivated organism with predicted taxonomy: Clostridium sp. CAG:964
  MG18-142 HNH domain

SEQ ID NO: 5129 - protein, 162 aa, Unknown; identical to SEQ ID NO: 5121
  Description of Unknown: uncultivated organism with predicted taxonomy: Clostridiales
  MG18-143 HNH domain

SEQ ID NO: 5130 - protein, 162 aa, Unknown; identical to SEQ ID NO: 5122
  Description of Unknown: uncultivated organism with predicted taxonomy: Firmicutes
  MG18-144 HNH domain

SEQ ID NO: 5131 - protein, 162 aa, Unknown; identical to SEQ ID NO: 5122
  Description of Unknown: uncultivated organism with predicted taxonomy: Dorea sp. OM02-2LB
  MG18-145 HNH domain

SEQ ID NO: 5132 - protein, 168 aa, Unknown; identical to SEQ ID NO: 5125
  Description of Unknown: uncultivated organism with predicted taxonomy: Phascolarctobacterium succinatutens
  MG18-146 HNH domain

SEQ ID NO: 5133 - protein, 168 aa, Unknown; identical to SEQ ID NO: 5125
  Description of Unknown: uncultivated organism with predicted taxonomy: Firmicutes
  MG18-147 HNH domain

SEQ ID NO: 5134 - protein, 168 aa, Unknown
  Description of Unknown: uncultivated organism with predicted taxonomy: Lactobacillus oryzae
  MG18-148 HNH domain
SKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQL

SEQ ID NO: 5135 - protein, 168 aa, Unknown; identical to SEQ ID NO: 5017
  Description of Unknown: uncultivated organism with predicted taxonomy: Phascolarctobacterium
  MG18-149 HNH domain

SEQ ID NO: 5136 - protein, 168 aa, Unknown
  Description of Unknown: uncultivated organism with predicted taxonomy: Firmicutes
  MG18-150 HNH domain
SKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVNKEVNAAKTDIYPLDAAIRTKMHSFWKLLYDKGFIDERKYERLTRSTQLRDEELAGFISRQL

SEQ ID NO: 5137 - protein, 168 aa, Unknown
  Description of Unknown: uncultivated organism with predicted taxonomy: Phascolarctobacterium
  MG18-151 HNH domain
SKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5138 - protein, 168 aa, Unknown; identical to SEQ ID NO: 5017
  Description of Unknown: uncultivated organism with predicted taxonomy: Phascolarctobacterium succinatutens
  MG18-152 HNH domain

SEQ ID NO: 5139 - protein, 168 aa, Unknown; identical to SEQ ID NO: 5124
  Description of Unknown: uncultivated organism with predicted taxonomy: Firmicutes
  MG18-153 HNH domain

SEQ ID NO: 5140 - protein, 168 aa, Unknown; identical to SEQ ID NO: 5011
  Description of Unknown: uncultivated organism with predicted taxonomy: Phascolarctobacterium succinatutens
  MG18-154 HNH domain

SEQ ID NO: 5141 - protein, 168 aa, Unknown; identical to SEQ ID NO: 4996
  Description of Unknown: uncultivated organism with predicted taxonomy: Phascolarctobacterium succinatutens
  MG18-155 HNH domain

SEQ ID NO: 5142 - protein, 168 aa, Unknown; identical to SEQ ID NO: 5127
  Description of Unknown: uncultivated organism with predicted taxonomy: Clostridium sp. CAG:964
  MG18-156 HNH domain

SEQ ID NO: 5143 - protein, 168 aa, Unknown
  Description of Unknown: uncultivated organism with predicted taxonomy: Ruminococcaceae bacterium
  MG18-157 HNH domain
SKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKEVNAAKTDIYPLDAVIRTKMHSFWKLLYDKGFIDERKYERLTRSTQLRDEELAGFISRQL

SEQ ID NO: 5144 - protein, 168 aa, Unknown; identical to SEQ ID NO: 4996
  Description of Unknown: uncultivated organism with predicted taxonomy: Clostridium sp. CAG:964
  MG18-158 HNH domain

SEQ ID NO: 5145 - protein, 168 aa, Unknown; identical to SEQ ID NO: 5026
  Description of Unknown: uncultivated organism with predicted taxonomy: Phascolarctobacterium succinatutens
  MG18-159 HNH domain

SEQ ID NO: 5146 - protein, 158 aa, Unknown
  Description of Unknown: uncultivated organism with predicted taxonomy: Clostridiales
  MG18-160 HNH domain
GPGEKKRTVSRKDALIELYKTLKSDERDWINEIAVQPEDRFRSDRLYFYYLQLGKCLYTGKPIDLDQIYNEMVYDVDHIYPQSKVKDDSLVNRVLVDSTKNKEKSDRYPIDKEIRDRMKPFWKMLLQQGFMEKEKYERLTRSTPFSDNELAEFIARQL

SEQ ID NO: 5147 - protein, 158 aa, Unknown
  Description of Unknown: uncultivated organism with predicted taxonomy: Firmicutes
  MG21-1 HNH domain
EMGKNFKDRGKIAKSQADHAAKNERIKAQISEYKSDHITGQDIVKFKLFKEQDGICLYSGKSLDIARLFEPGYVDVDHIIPYSISFDDSYNNKVLVLSSENRQKGNRIPYAYFGQNSDRWEKYETLVSNTVRSYRKRKNLLLKSLSEAQIDGFKQRNL

SEQ ID NO: 5148 - protein, 160 aa, Unknown
  Description of Unknown: uncultivated organism with predicted taxonomy: Roseburia sp. AM23-20
  MG21-3 HNH domain
DMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNL

SEQ ID NO: 5149 - protein, 160 aa, Unknown; identical to SEQ ID NO: 5148
  Description of Unknown: uncultivated organism with predicted taxonomy: Clostridiales
  MG21-4 HNH domain

SEQ ID NO: 5150 - protein, 160 aa, Unknown; identical to SEQ ID NO: 5148
  Description of Unknown: uncultivated organism
  MG21-5 HNH domain

SEQ ID NO: 5151 - protein, 160 aa, Unknown; identical to SEQ ID NO: 5148
  Description of Unknown: uncultivated organism
  MG21-6 HNH domain

SEQ ID NO: 5152 - protein, 157 aa, Unknown
  Description of Unknown: uncultivated organism with predicted taxonomy: Clostridium sp. CAG:571
  MG21-7 HNH domain
ELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNL

SEQ ID NO: 5153 - protein, 159 aa, Unknown
  Description of Unknown: uncultivated organism with predicted taxonomy: Clostridiales
  MG21-8 HNH domain
EMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNL

SEQ ID NO: 5154 - protein, 160 aa, Unknown
  Description of Unknown: uncultivated organism
  MG21-9 HNH domain
DMKRNFTDRQDIKKKQDSNWSYNDKIREKVEELKGSAATGQDIVKMKLYEEQDGYCLYSGKQLDIRRLFEVGYAEVDHIVPYSKCFDDSYNNKVLVFSSENQRKGNRLPLEYMLAEGDEDKLDDYVTLVEARIKNTRKKQRLLKPCLTAEDSNDWKERNL

SEQ ID NO: 5155 - protein, 157 aa, Unknown
  Description of Unknown: uncultivated organism with predicted taxonomy: Clostridiales
  MG21-10 HNH domain
ELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNVEEYEIRVNTLIRNNKKKQNLLRQDFTREDAEDWKERNL

SEQ ID NO: 5156 - protein, 157 aa, Unknown
  Description of Unknown: uncultivated organism with predicted taxonomy: Clostridiales
  MG21-11 HNH domain
ELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDSEDWKERNL

SEQ ID NO: 5157 - protein, 160 aa, Unknown
  Description of Unknown: uncultivated organism with predicted taxonomy: Helicobacter sp. MIT 11-5569
  MG21-12 HNH domain
DMKRNFADRQDIKKKQDNNWSCNDRIRQKVEEYKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNL

SEQ ID NO: 5158 - protein, 157 aa, Unknown
  Description of Unknown: uncultivated organism with predicted taxonomy: Clostridium
  MG21-13 HNH domain
EMGKNFNDRSKIKKSQEENMQRNENIRQAIIELGKSNPTGQDIVKYKLWQEQDNFCVYSGKKITVDMLFTEAVDVDHIIPYSMCFDDTYNNKVLVLASENRQKGNRVPYKYEKEIGRNIDEYVVRVGNIIKNPKKLRRLLREDFTKEDAKDWKNRNI

SEQ ID NO: 5159 - protein, 157 aa, Unknown
  Description of Unknown: uncultivated organism with predicted taxonomy: Clostridiales
  MG21-14 HNH domain
ELGKSFKERQSIEKIYEENRTRNEKAIQEIRELGKTNVTGKDIVKYKLWKDQNEICIYSGKHIKVEDLFTDAVDIDHIIPYSQCFDDTYKNKVLVLASENRQKGNRTAYKYIKEAGKNLEEYEVRVNNYIKDYRKKERLLKADFSTEDAKNWKDRNI

SEQ ID NO: 5160 - protein, 157 aa, Unknown
  Description of Unknown: uncultivated organism
  MG21-15 HNH domain
EMGRNFKDRNIIKKSQEINMKNNEFVKERIVELGKENPRGQDIVKYKLWQEQDGVCIYSGKKIPIENLFTEAVDVDHIIPYSMCFDDTYNNKVLVLASENRQKGNRVPYKYEKEIGRDIEEYEVRVNNIIKNPYKRVKLLREDFTREDALEWKDRNI

SEQ ID NO: 5161 - protein, 160 aa, Unknown
  Description of Unknown: uncultivated organism
  MG21-16 HNH domain
DMKRNFTDRQDIKKKQDNNWSYNDRIRQKVEELKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNL

SEQ ID NO: 5162 - protein, 158 aa, Unknown
  Description of Unknown: uncultivated organism with predicted taxonomy: Clostridiales
  MG21-17 HNH domain
EMSQNFDDRRKAEKRQEENRAANERVKEQIAEYKGDRATGLDIVKFKLYREQDGVCLYSGKNLDIGRLFEPGYADVDHIIPYSRCFDDSYQNKVLVLASENRQKGNRLPYEYFGQDETRWHEYEVRVENLIRNYRKRQKLLKKQLTEEESTGFIDRNL

SEQ ID NO: 5163 - protein, 158 aa, Unknown
  Description of Unknown: uncultivated organism with predicted taxonomy: Clostridiales bacterium 42_27
  MG21-18 HNH domain
EMSRNFDDRRKAEKRQEENRAANERAKEQIVEYKGDCATGLDIVKFKLYREQDGVCLYSGQNLDLSRLFEPGYVDVDHIIPYSRCFDDSYQNKTLVLASENRQKGNRLPYEYFGQDEARWHEYEVRVENLIRNYRKRQRLLKKRLTEDESAGFIDRNL

SEQ ID NO: 5164 - protein, 182 aa, Unknown
  Description of Unknown: uncultivated organism
  MG21-19 HNH domain
DIKCGSRTRERIAQENEANRERREKLINEVENIKKQKHCEKVNATEQEILKLQLYKDQHGKCLYSGKELDKDKVISESGYAEIDHIIPYSQSFDNSEANKVLTLSEENRNKGNDVPVAYILRKHKNSEKEYDAFVKRVKSVTKEVSNTNKDRQKILEKRKQNLLISPNFKVDELEGLLVRET

SEQ ID NO: 5165 - protein, 158 aa, Unknown; identical to SEQ ID NO: 5162
  Description of Unknown: uncultivated organism with predicted taxonomy: Clostridiales
  MG21-20 HNH domain

SEQ ID NO: 5166 - protein, 157 aa, Unknown
  Description of Unknown: uncultivated organism with predicted taxonomy: Clostridiales bacterium 42_27
  MG21-21 HNH domain
ELGKNFADRKAIEKRQNDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNL

SEQ ID NO: 5167 - protein, 158 aa, Unknown
  Description of Unknown: uncultivated organism with predicted taxonomy: Clostridiales
  MG21-22 HNH domain
EMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5168 - protein, 159 aa, Unknown
  Description of Unknown: uncultivated organism with predicted taxonomy: Roseburia inulinivorans
  MG21-23 HNH domain
EMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNL

SEQ ID NO: 5169 - protein, 159 aa, Unknown
  Description of Unknown: uncultivated organism with predicted taxonomy: Firmicutes
  MG21-24 HNH domain
EMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAEENRQKGNRTPYEYFGADEQRWHEFSARVRASVRDFKKRQKLLNTSFGEEQKNEFTQRNL

SEQ ID NO: 5170 - protein, 158 aa, Unknown
  Description of Unknown: uncultivated organism with predicted taxonomy: Clostridiales bacterium 42_27
  MG21-25 HNH domain
EMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5171 - protein, 158 aa, Unknown; identical to SEQ ID NO: 5170
  Description of Unknown: uncultivated organism with predicted taxonomy: Ruminococcaceae bacterium TF06-43
  MG21-26 HNH domain

SEQ ID NO: 5172 - protein, 158 aa, Unknown
  Description of Unknown: uncultivated organism with predicted taxonomy: Clostridiales
  MG21-27 HNH domain
EMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNL

SEQ ID NO: 5173 - protein, 158 aa, Unknown
  Description of Unknown: uncultivated organism with predicted taxonomy: Clostridiales bacterium 42_27
  MG21-28 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5174 - protein, 158 aa, Unknown
  Description of Unknown: uncultivated organism with predicted taxonomy: Firmicutes
  MG21-29 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGNDDVRWHEYEVRVENLIRNYRKRQKLLKRQLSEEESAGFIDRNL

SEQ ID NO: 5175 - protein, 158 aa, Unknown; identical to SEQ ID NO: 5170
  Description of Unknown: uncultivated organism with predicted taxonomy: Clostridiales bacterium 42_27
  MG21-30 HNH domain

SEQ ID NO: 5176 - protein, 159 aa, Unknown
  Description of Unknown: uncultivated organism
  MG21-31 HNH domain
EMHHSIKERNRMKKRQEENREKNEQVKAQILETKPGTRVTGLDIVKFKLYQEQDGICLYSGKPLEIERLYEPGYAEVDHIIPYSRCFDDSYSNKVLVLAEENQQKGNCTPYEYFGADEQRWHEFSVRVGASVRDFKKRQKLLNTSFGEEQGKDFIQRNL

SEQ ID NO: 5177 - protein, 158 aa, Unknown
  Description of Unknown: uncultivated organism with predicted taxonomy: Ruminococcaceae bacterium TF06-43
  MG21-32 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNL

SEQ ID NO: 5178 - protein, 158 aa, Unknown
  Description of Unknown: uncultivated organism with predicted taxonomy: Clostridiales
  MG21-33 HNH domain
EMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNL

SEQ ID NO: 5179 - protein, 158 aa, Unknown
  Description of Unknown: uncultivated organism with predicted taxonomy: Clostridiales
  MG21-34 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNL

SEQ ID NO: 5180 - protein, 158 aa, Unknown
  Description of Unknown: uncultivated organism with predicted taxonomy: Clostridiales
  MG21-35 HNH domain
EMSRTFDERRKMEKRQDDNRAANERAKNQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5181 - protein, 157 aa, Unknown
  Description of Unknown: uncultivated organism
  MG21-36 HNH domain
ELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNKIPYQYMQEKGRDLDEYEIRVNNIIKNYSKKQRLLKQKFTREDANEWKDRNI

SEQ ID NO: 5182 - protein, 158 aa, Unknown
  Description of Unknown: uncultivated organism with predicted taxonomy: Clostridiales
  MG21-37 HNH domain
EMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5183 - protein, 158 aa, Unknown; identical to SEQ ID NO: 5173
  Description of Unknown: uncultivated organism with predicted taxonomy: Clostridiales bacterium 42_27
  MG21-38 HNH domain

SEQ ID NO: 5184 - protein, 158 aa, Unknown
  Description of Unknown: uncultivated organism with predicted taxonomy: Clostridiales
  MG21-39 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNL

SEQ ID NO: 5185 - protein, 158 aa, Unknown
  Description of Unknown: uncultivated organism with predicted taxonomy: Clostridiales
  MG21-40 HNH domain
EMSQNFEKRRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDEARWHGYEVRVENLIRNYRKRQKLLKKRLTEEESAGFIDRNL

SEQ ID NO: 5186 - protein, 159 aa, Unknown
  Description of Unknown: uncultivated organism with predicted taxonomy: Firmicutes
  MG21-41 HNH domain
EMSHSFDERNKMKKRQEDGWQKNEQVKAQILETKTGTRVTGLDIVKFKLYQEQDGICLYSGTPMEIERLYEPGYADVDHIIPYSRCFDDSYSNKVLVLASENRQKGNRTPYEYFGANEQRWHEFSVRVGASVRDFKKRQKLLNTSFGEEQGKEFIQRNL

SEQ ID NO: 5187 - protein, 157 aa, Unknown
  Description of Unknown: uncultivated organism with predicted taxonomy: Clostridiales
  MG21-42 HNH domain
ELGKNFADRRTIEKRQSDNTQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNSKKKQNLLRQDFTREDAEDWKERNL

SEQ ID NO: 5188 - protein, 158 aa, Unknown
  Description of Unknown: uncultivated organism with predicted taxonomy: Clostridiales bacterium 42_27
  MG21-43 HNH domain
EMSRTFDERRKMEKRQDDNRAANKRAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5189 - protein, 157 aa, Unknown
  Description of Unknown: uncultivated organism with predicted taxonomy: Clostridiales
  MG21-44 HNH domain
QLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNI

SEQ ID NO: 5190 - protein, 158 aa, Unknown; identical to SEQ ID NO: 5170
  Description of Unknown: uncultivated organism with predicted taxonomy: Clostridiales
  MG21-45 HNH domain

SEQ ID NO: 5191 - protein, 157 aa, Unknown; identical to SEQ ID NO: 5187
  Description of Unknown: uncultivated organism with predicted taxonomy: Clostridiales
  MG21-46 HNH domain

SEQ ID NO: 5192 - protein, 158 aa, Unknown; identical to SEQ ID NO: 5172
  Description of Unknown: uncultivated organism with predicted taxonomy: Clostridiales
  MG21-47 HNH domain

SEQ ID NO: 5193 - protein, 158 aa, Unknown; identical to SEQ ID NO: 5182
  Description of Unknown: uncultivated organism with predicted taxonomy: Clostridiales bacterium 42_27
  MG21-48 HNH domain

SEQ ID NO: 5194 - protein, 158 aa, Unknown
  Description of Unknown: uncultivated organism with predicted taxonomy: Clostridiales bacterium 42_27
  MG21-49 HNH domain
EMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5195 - protein, 158 aa, Unknown; identical to SEQ ID NO: 5173
  Description of Unknown: uncultivated organism with predicted taxonomy: Clostridiales bacterium 42_27
  MG21-50 HNH domain

SEQ ID NO: 5196 - protein, 158 aa, Unknown; identical to SEQ ID NO: 5173
  Description of Unknown: uncultivated organism with predicted taxonomy: Clostridiales bacterium 42_27
  MG21-51 HNH domain

SEQ ID NO: 5197 - protein, 158 aa, Unknown
  Description of Unknown: uncultivated organism with predicted taxonomy: Clostridiales bacterium 42_27
  MG21-52 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5198 - protein, 158 aa, Unknown
  Description of Unknown: uncultivated organism with predicted taxonomy: Clostridiales
  MG21-53 HNH domain
EMGKPYDVRTQITKKQEANAKKNEELRQQIKKIKGAEPTGQDIVKFKLFQEQKGVCLYSGQNLDITRLFEAGYVDVDHIVPYSISFDDSYTNKVLVRSPENRQKGNRIPADYFKSDPARWQRFETLVNTRVHNWKKKRNLLTQALSEEQKNGFKQRNL

SEQ ID NO: 5199 - protein, 158 aa, Unknown
  Description of Unknown: uncultivated organism with predicted taxonomy: Clostridiales
  MG21-54 HNH domain
EMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNL

SEQ ID NO: 5200 - protein, 159 aa, Unknown
  Description of Unknown: uncultivated organism with predicted taxonomy: Ruminococcaceae bacterium TF06-43
  MG21-55 HNH domain
EMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAKENQQKGNCTPYEYFGADEQRWHEFSARVRASVRDFKKRQKLLNTSFGEEQGKEFIQRNL

SEQ ID NO: 5201 - protein, 158 aa, Unknown; identical to SEQ ID NO: 5173
  Description of Unknown: uncultivated organism with predicted taxonomy: Clostridiales bacterium 42_27
  MG21-56 HNH domain

SEQ ID NO: 5202 - protein, 158 aa, Unknown
  Description of Unknown: uncultivated organism
  MG21-57 HNH domain
EMGKNFKDRRMIETRQTDNAAKNERIKAQISEYKSDHITGQDIVKFKLFKEQDGICLYSGKSLNIARLFEPGYVDIDHIIPYSISFDDSYNNKVLVLSSENRQKGNRIPYAYFGQNSDRWEKYETLVNNTVRSYRKRKNLLLKSLSEAQIDGFKQRNL

SEQ ID NO: 5203 - protein, 158 aa, Unknown
  Description of Unknown: uncultivated organism with predicted taxonomy: Oscillibacter sp. CAG:241_62_21
  MG21-58 HNH domain
EMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNL

SEQ ID NO: 5204 - protein, 158 aa, Unknown; identical to SEQ ID NO: 5203
  Description of Unknown: uncultivated organism with predicted taxonomy: Clostridiales
  MG21-59 HNH domain

SEQ ID NO: 5205 - protein, 158 aa, Unknown; identical to SEQ ID NO: 5173
  Description of Unknown: uncultivated organism with predicted taxonomy: Firmicutes
  MG21-60 HNH domain

SEQ ID NO: 5206 - protein, 158 aa, Unknown; identical to SEQ ID NO: 5179
  Description of Unknown: uncultivated organism with predicted taxonomy: Clostridiales
  MG21-61 HNH domain

SEQ ID NO: 5207 - protein, 158 aa, Unknown; identical to SEQ ID NO: 5182
  Description of Unknown: uncultivated organism with predicted taxonomy: Firmicutes bacterium CAG:129
  MG21-62 HNH domain

SEQ ID NO: 5208 - protein, 158 aa, Unknown; identical to SEQ ID NO: 5184
  Description of Unknown: uncultivated organism with predicted taxonomy: Clostridiales
  MG21-63 HNH domain

SEQ ID NO: 5209 - protein, 158 aa, Unknown; identical to SEQ ID NO: 5184
  Description of Unknown: uncultivated organism with predicted taxonomy: Clostridiales
  MG21-64 HNH domain

SEQ ID NO: 5210 - protein, 158 aa, Unknown; identical to SEQ ID NO: 5172
  Description of Unknown: uncultivated organism with predicted taxonomy: Clostridiales bacterium 42_27
  MG21-65 HNH domain

SEQ ID NO: 5211 - protein, 158 aa, Unknown; identical to SEQ ID NO: 5184
  Description of Unknown: uncultivated organism with predicted taxonomy: Clostridiales
  MG21-66 HNH domain

SEQ ID NO: 5212 - protein, 158 aa, Unknown; identical to SEQ ID NO: 5174
  Description of Unknown: uncultivated organism with predicted taxonomy: Clostridia
  MG21-67 HNH domain

SEQ ID NO: 5213 - protein, 158 aa, Unknown; identical to SEQ ID NO: 5194
  Description of Unknown: uncultivated organism with predicted taxonomy: Clostridiales
  MG21-68 HNH domain

SEQ ID NO: 5214 - protein, 159 aa, Unknown
  Description of Unknown: uncultivated organism with predicted taxonomy: Firmicutes
  MG21-69 HNH domain
EMHHSIKERNRMKKRQEENREKNEQVKAQILETKPGTRVTGLDIVKFKLHQEQKGFCPYSGVEIKKERLYEPGYAEVDHIIPYSRCFDDSYSNKVLVLAEENRQKGNRTPYEYFGADEQRWHEFSARVRASVQDFKKRQKLLNTSFGEEQKNEFTQRNL

SEQ ID NO: 5215 - protein, 159 aa, Unknown
  Description of Unknown: uncultivated organism with predicted taxonomy: Firmicutes
  MG21-70 HNH domain
EMSHSFDERNKMKKRQEDGWRKNEQVKAQILETKTGNRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNL

SEQ ID NO: 5216 - protein, 159 aa, Unknown; identical to SEQ ID NO: 5169
  Description of Unknown: uncultivated organism with predicted taxonomy: Clostridiales
  MG21-71 HNH domain

SEQ ID NO: 5217 - protein, 159 aa, Unknown; identical to SEQ ID NO: 5168
  Description of Unknown: uncultivated organism
  MG21-72 HNH domain

SEQ ID NO: 5218 - protein, 158 aa, Unknown; identical to SEQ ID NO: 5177
  Description of Unknown: uncultivated organism with predicted taxonomy: Clostridiales
  MG21-73 HNH domain

SEQ ID NO: 5219 - protein, 159 aa, Unknown
  Description of Unknown: uncultivated organism with predicted taxonomy: Firmicutes
  MG21-74 HNH domain
EMSHSFDERNKIKKRQEDGRRKNEQIKAQILETKAGHRVTGLDIVKFKLFQEQDGVCPYSGKALDVQRLYEPGYADVDHIIPYSRCFDDSYSNKVLVLASENRQKGNCTPYEYFGADERRWHEFSVRVGASVRDFKKRQKLLNTSFGEEQGKEFIQRNL

SEQ ID NO: 5220 - protein, 157 aa, Unknown
  Description of Unknown: uncultivated organism with predicted taxonomy: Clostridiales
  MG21-75 HNH domain
ELSKNFADRQNIKKNQENNMQSNEKAKEDILKLGKSNPTGQDIVKYKLWKEQDGICVYSGKRISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNI

SEQ ID NO: 5221 - protein, 158 aa, Unknown; identical to SEQ ID NO: 5194
  Description of Unknown: uncultivated organism with predicted taxonomy: Clostridiales bacterium 42_27
  MG21-76 HNH domain

SEQ ID NO: 5222 - protein, 158 aa, Unknown
  Description of Unknown: uncultivated organism with predicted taxonomy: Clostridiales
  MG21-77 HNH domain
EMGKPYDVRTQITKKQEANAKKNEEVKQKIREIKGLEPTGQDIVKFKLFQDQNGVCLYSGQSLDITRLFEAGYVDVDHIIPYSISFDDSYTNKVLVRSPENRQKGNRIPADYFKSDPARWQRFETLVNTRVHNWKKKRNLLTQALSEEQKNGFKQRNL

SEQ ID NO: 5223 - protein, 158 aa, Unknown; identical to SEQ ID NO: 5194
  Description of Unknown: uncultivated organism with predicted taxonomy: Clostridiales bacterium 42_27
  MG21-78 HNH domain

SEQ ID NO: 5224 - protein, 158 aa, Unknown; identical to SEQ ID NO: 5199
  Description of Unknown: uncultivated organism with predicted taxonomy: Clostridiales
  MG21-79 HNH domain

SEQ ID NO: 5225 - protein, 158 aa, Unknown
  Description of Unknown: uncultivated organism with predicted taxonomy: Clostridiales
  MG21-80 HNH domain
EMGKNFKDRRMIETRQTDNAAKNERIKAQISEYKSDHITGQDIVKFKLFKEQDGICLYSGKSLDIARLFEPGYVDIDHIIPYSISFDDSYNNKVLVQSSENRQKGNRIPYAYFGQNSDRWEKYETLVNNTVRSYRKRKNLLLKSLSEAQIDGFKQRNL

SEQ ID NO: 5226 - protein, 158 aa, Unknown
  Description of Unknown: uncultivated organism with predicted taxonomy: Clostridiales
  MG21-81 HNH domain
EMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNL

SEQ ID NO: 5227 - protein, 158 aa, Unknown; identical to SEQ ID NO: 5194
  Description of Unknown: uncultivated organism with predicted taxonomy: Clostridiales bacterium 42_27
  MG21-82 HNH domain

SEQ ID NO: 5228 - protein, 158 aa, Unknown; identical to SEQ ID NO: 5194
  Description of Unknown: uncultivated organism with predicted taxonomy: Clostridiales bacterium 42_27
  MG21-83 HNH domain

SEQ ID NO: 5229 - protein, 158 aa, Unknown; identical to SEQ ID NO: 5184
  Description of Unknown: uncultivated organism with predicted taxonomy: Clostridiales
  MG21-84 HNH domain

SEQ ID NO: 5230 - protein, 158 aa, Unknown
  Description of Unknown: uncultivated organism with predicted taxonomy: Clostridiales
  MG21-85 HNH domain
EMGKSKADRDKIDAEQKANAKRNEELRQQIKKIKGAEPTGQDIVKFKLFQDQNGVCLYSGQNLDITRLFEAGYVEIDHIIPYSISLDNSYANKVLVLKEENQNKGRRTPYEYFGADSKRWQRFETLVNTQVHNWKKKRNLLTQALSEEQKNGFKQRNL

SEQ ID NO: 5231 - protein, 158 aa, Unknown; identical to SEQ ID NO: 5226
  Description of Unknown: uncultivated organism with predicted taxonomy: Firmicutes
  MG21-86 HNH domain

SEQ ID NO: 5232 - protein, 158 aa, Unknown; identical to SEQ ID NO: 5179
  Description of Unknown: uncultivated organism with predicted taxonomy: Clostridiales
  MG21-87 HNH domain

SEQ ID NO: 5233 - protein, 158 aa, Unknown; identical to SEQ ID NO: 5178
  Description of Unknown: uncultivated organism with predicted taxonomy: Clostridiales
  MG21-88 HNH domain

SEQ ID NO: 5234 - protein, 158 aa, Unknown; identical to SEQ ID NO: 5179
  Description of Unknown: uncultivated organism with predicted taxonomy: Clostridiales
  MG21-89 HNH domain

SEQ ID NO: 5235 - protein, 158 aa, Unknown; identical to SEQ ID NO: 5194
  Description of Unknown: uncultivated organism with predicted taxonomy: Clostridiales bacterium 42_27
  MG21-90 HNH domain

SEQ ID NO: 5236 - protein, 158 aa, Unknown; identical to SEQ ID NO: 5194
  Description of Unknown: uncultivated organism with predicted taxonomy: Clostridiales bacterium 42_27
  MG21-91 HNH domain

SEQ ID NO: 5237 - protein, 158 aa, Unknown; identical to SEQ ID NO: 5179
  Description of Unknown: uncultivated organism with predicted taxonomy: Ruminococcaceae bacterium TF06-43
  MG21-92 HNH domain

SEQ ID NO: 5238 - protein, 158 aa, Unknown; identical to SEQ ID NO: 5179
  Description of Unknown: uncultivated organism with predicted taxonomy: Ruminococcaceae bacterium TF06-43
  MG21-93 HNH domain

SEQ ID NO: 5239 - protein, 158 aa, Unknown; identical to SEQ ID NO: 5184
  Description of Unknown: uncultivated organism with predicted taxonomy: Clostridiales
  MG21-94 HNH domain

SEQ ID NO: 5240 - protein, 158 aa, Unknown; identical to SEQ ID NO: 5194
  Description of Unknown: uncultivated organism with predicted taxonomy: Clostridiales bacterium 42_27
  MG21-95 HNH domain

SEQ ID NO: 5241 - protein, 158 aa, Unknown; identical to SEQ ID NO: 5194
  Description of Unknown: uncultivated organism with predicted taxonomy: Clostridiales bacterium 42_27
  MG21-96 HNH domain

SEQ ID NO: 5242 - protein, 157 aa, Unknown; identical to SEQ ID NO: 5189
  Description of Unknown: uncultivated organism with predicted taxonomy: Clostridium
  MG21-97 HNH domain

SEQ ID NO: 5243 - protein, 160 aa, Unknown
  Description of Unknown: uncultivated organism with predicted taxonomy: Clostridiales
  MG21-98 HNH domain
EMGKSKADRDKIDAEQKANAKRNEELRQQIKKIKGAEPTGQDIVKFKLFQEQKGVCLYSGKNIEIDRLFKPEAGYVEIDHIIPYSISLDNSYANKVLVLKEENQNKGRRTPYEYFGADSKRWQRFETLVNTQVHNWKKKRNLLTQALSEEQKNGFKQRNL

SEQ ID NO: 5244 - protein, 158 aa, Unknown; identical to SEQ ID NO: 5173
  Description of Unknown: uncultivated organism with predicted taxonomy: Clostridiales bacterium 42_27
  MG21-99 HNH domain

SEQ ID NO: 5245 - protein, 158 aa, Unknown
  Description of Unknown: uncultivated organism with predicted taxonomy: Clostridiales
  MG21-100 HNH domain
EMSRNFDERRKAEKRQDENRAANERAKEQIAEYKGDHATGLDIVKFKLYQEQDGVYLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNL

SEQ ID NO: 5246 - protein, 157 aa, Unknown
  Description of Unknown: uncultivated organism with predicted taxonomy: Clostridiales
  MG21-101 HNH domain
ELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNI

SEQ ID NO: 5247 - protein, 157 aa, Unknown; identical to SEQ ID NO: 5189
  Description of Unknown: uncultivated organism with predicted taxonomy: Clostridium
  MG21-102 HNH domain

SEQ ID NO: 5248 - protein, 158 aa, Unknown
  Description of Unknown: uncultivated organism with predicted taxonomy: Clostridiales
  MG21-103 HNH domain
EMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNL

SEQ ID NO: 5249 - protein, 158 aa, Unknown; identical to SEQ ID NO: 5194
  Description of Unknown: uncultivated organism with predicted taxonomy: Clostridiales bacterium 42_27
  MG21-104 HNH domain

SEQ ID NO: 5250 - protein, 158 aa, Unknown; identical to SEQ ID NO: 5197
  Description of Unknown: uncultivated organism with predicted taxonomy: Clostridiales bacterium 42_27
  MG21-105 HNH domain

SEQ ID NO: 5251 - protein, 158 aa, Unknown; identical to SEQ ID NO: 5203
  Description of Unknown: uncultivated organism with predicted taxonomy: Oscillibacter sp. CAG:241_62_21
  MG21-106 HNH domain

SEQ ID NO: 5252 - protein, 157 aa, Unknown; identical to SEQ ID NO: 5189
  Description of Unknown: uncultivated organism with predicted taxonomy: Clostridium
  MG21-107 HNH domain

SEQ ID NO: 5253 - protein, 158 aa, Unknown; identical to SEQ ID NO: 5179
  Description of Unknown: uncultivated organism with predicted taxonomy: Clostridiales
  MG21-108 HNH domain

SEQ ID NO: 5254 - protein, 158 aa, Unknown; identical to SEQ ID NO: 5197
  Description of Unknown: uncultivated organism with predicted taxonomy: Clostridiales bacterium 42_27
  MG21-109 HNH domain

SEQ ID NO: 5255 - protein, 158 aa, Unknown; identical to SEQ ID NO: 5203
  Description of Unknown: uncultivated organism with predicted taxonomy: Oscillibacter sp. CAG:241_62_21
  MG21-110 HNH domain

SEQ ID NO: 5256 - protein, 158 aa, Unknown; identical to SEQ ID NO: 5248
  Description of Unknown: uncultivated organism with predicted taxonomy: Clostridiales
  MG21-111 HNH domain

SEQ ID NO: 5257 - protein, 158 aa, Unknown; identical to SEQ ID NO: 5173
  Description of Unknown: uncultivated organism with predicted taxonomy: Clostridiales bacterium 42_27
  MG21-112 HNH domain

SEQ ID NO: 5258 - protein, 158 aa, Unknown; identical to SEQ ID NO: 5194
  Description of Unknown: uncultivated organism with predicted taxonomy: Clostridiales bacterium 42_27
  MG21-113 HNH domain

SEQ ID NO: 5259 - protein, 158 aa, Unknown; identical to SEQ ID NO: 5197
  Description of Unknown: uncultivated organism with predicted taxonomy: Clostridiales bacterium 42_27
  MG21-114 HNH domain

SEQ ID NO: 5260 - protein, 158 aa, Unknown
  Description of Unknown: uncultivated organism with predicted taxonomy: Clostridiales
  MG21-115 HNH domain
EMGKPYDVRTQMTKKQETNAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQVLSEEQKNGFKQRNL

SEQ ID NO: 5261 - protein, 158 aa, Unknown; identical to SEQ ID NO: 5179
  Description of Unknown: uncultivated organism with predicted taxonomy: Clostridiales
  MG21-116 HNH domain

SEQ ID NO: 5262 - protein, 158 aa, Unknown; identical to SEQ ID NO: 5173
  Description of Unknown: uncultivated organism with predicted taxonomy: Clostridiales bacterium 42_27
  MG21-117 HNH domain

SEQ ID NO: 5263 - protein, 158 aa, Unknown; identical to SEQ ID NO: 5170
  Description of Unknown: uncultivated organism with predicted taxonomy: Clostridiales bacterium 42_27
  MG21-118 HNH domain

SEQ ID NO: 5264 - protein, 158 aa, Unknown; identical to SEQ ID NO: 5194
  Description of Unknown: uncultivated organism with predicted taxonomy: Clostridiales bacterium 42_27
  MG21-119 HNH domain

SEQ ID NO: 5265 - protein, 158 aa, Unknown; identical to SEQ ID NO: 5179
  Description of Unknown: uncultivated organism with predicted taxonomy: Ruminococcaceae bacterium TF06-43
  MG21-120 HNH domain

SEQ ID NO: 5266 - protein, 158 aa, Unknown; identical to SEQ ID NO: 5248
  Description of Unknown: uncultivated organism with predicted taxonomy: Clostridiales
  MG21-121 HNH domain

SEQ ID NO: 5267 - protein, 159 aa, Unknown; identical to SEQ ID NO: 5214
  Description of Unknown: uncultivated organism
  MG21-122 HNH domain

SEQ ID NO: 5268 - protein, 158 aa, Unknown; identical to SEQ ID NO: 5173
  Description of Unknown: uncultivated organism with predicted taxonomy: Clostridiales
  MG21-123 HNH domain

SEQ ID NO: 5269 - protein, 158 aa, Unknown; identical to SEQ ID NO: 5173
  Description of Unknown: uncultivated organism with predicted taxonomy: Clostridiales bacterium 42_27
  MG21-124 HNH domain

SEQ ID NO: 5270 - protein, 158 aa, Unknown; identical to SEQ ID NO: 5173
  Description of Unknown: uncultivated organism with predicted taxonomy: Clostridiales bacterium 42_27
  MG21-125 HNH domain

SEQ ID NO: 5271 - protein, 158 aa, Unknown; identical to SEQ ID NO: 5194
  Description of Unknown: uncultivated organism with predicted taxonomy: Clostridiales bacterium 42_27
  MG21-126 HNH domain

SEQ ID NO: 5272 - protein, 158 aa, Unknown
  Description of Unknown: uncultivated organism with predicted taxonomy: Clostridiales bacterium 42_27
  MG21-127 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLNEEESTGFIDRNL

SEQ ID NO: 5273 - protein, 158 aa, Unknown; identical to SEQ ID NO: 5194
  Description of Unknown: uncultivated organism with predicted taxonomy: Clostridiales bacterium 42_27
  MG21-128 HNH domain

SEQ ID NO: 5274 - protein, 158 aa, Unknown
  Description of Unknown: uncultivated organism with predicted taxonomy: Clostridiales bacterium 42_27
  MG21-129 HNH domain
EMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIARNL

SEQ ID NO: 5275 - protein, 158 aa, Unknown
  Description of Unknown: uncultivated organism with predicted taxonomy: Clostridiales bacterium 42_27
  MG21-130 HNH domain
EMSRTFDERRKMEKRQDDNRAANERAKDQIAEYKGAHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNL

SEQ ID NO: 5276 - protein, 158 aa, Unknown; identical to SEQ ID NO: 5194
  Description of Unknown: uncultivated organism with predicted taxonomy: Clostridiales bacterium 42_27
  MG21-131 HNH domain

SEQ ID NO: 5277 - protein, 158 aa, Unknown; identical to SEQ ID NO: 5173
  Description of Unknown: uncultivated organism with predicted taxonomy: Clostridiales bacterium 42_27
  MG21-132 HNH domain

SEQ ID NO: 5278 - protein, 158 aa, Unknown; identical to SEQ ID NO: 5203
  Description of Unknown: uncultivated organism with predicted taxonomy: Clostridiales
  MG21-133 HNH domain

SEQ ID NO: 5279 - protein, 158 aa, Unknown; identical to SEQ ID NO: 5194
  Description of Unknown: uncultivated organism with predicted taxonomy: Clostridiales bacterium 42_27
  MG21-134 HNH domain

SEQ ID NO: 5280 - protein, 158 aa, Unknown; identical to SEQ ID NO: 5173
  Description of Unknown: uncultivated organism with predicted taxonomy: Clostridiales
  MG21-135 HNH domain

SEQ ID NO: 5281 - protein, 159 aa, Unknown; identical to SEQ ID NO: 5153
  Description of Unknown: uncultivated organism with predicted taxonomy: Clostridiales
  MG21-136 HNH domain

SEQ ID NO: 5282 - protein, 157 aa, Unknown; identical to SEQ ID NO: 5246
  Description of Unknown: uncultivated organism with predicted taxonomy: Clostridiales
  MG21-137 HNH domain

SEQ ID NO: 5283 - protein, 158 aa, Unknown; identical to SEQ ID NO: 5173
  Description of Unknown: uncultivated organism with predicted taxonomy: Clostridiales bacterium 42_27
  MG21-138 HNH domain

SEQ ID NO: 5284 - protein, 158 aa, Unknown; identical to SEQ ID NO: 5173
  Description of Unknown: uncultivated organism with predicted taxonomy: Clostridiales
  MG21-139 HNH domain

SEQ ID NO: 5285 - protein, 158 aa, Unknown; identical to SEQ ID NO: 5194
  Description of Unknown: uncultivated organism with predicted taxonomy: Clostridiales bacterium 42_27
  MG21-140 HNH domain

SEQ ID NO: 5286 - protein, 159 aa, Unknown
  Description of Unknown: uncultivated organism with predicted taxonomy: Firmicutes
  MG21-141 HNH domain
EMSHSFDERNKMKKRQEDGRQENEQVKAQILETKAGDRVTGLDIVKFKLYREQDGVCLYSGKGLDLQRLYEPGYADVDHIIPYSRCFDDSYSNKVLVLASENRQKGNCTPYEYFGENEQRWHEFSVRVGASVRDFKKRQKLLNTSFGEEQGKNFIQRNL

SEQ ID NO: 5287 - protein, 158 aa, Unknown; identical to SEQ ID NO: 5173
  Description of Unknown: uncultivated organism with predicted taxonomy: Clostridiales bacterium 42_27
  MG21-142 HNH domain

SEQ ID NO: 5288 - protein, 158 aa, Unknown; identical to SEQ ID NO: 5197
  Description of Unknown: uncultivated organism with predicted taxonomy: Clostridiales bacterium 42_27
  MG21-143 HNH domain

SEQ ID NO: 5289 - protein, 158 aa, Unknown
  Description of Unknown: uncultivated organism with predicted taxonomy: Clostridiales
  MG21-144 HNH domain
EMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWKRFETLVNTQVHNWKKKRNLLTQVLSEEQKNGFKQRNL

SEQ ID NO: 5290 - protein, 158 aa, Unknown
  Description of Unknown: uncultivated organism with predicted taxonomy: Clostridiales
  MG21-145 HNH domain
ELGKTFDERSKQEKRINENAARNEQAREQIREYKSGDSTGLDIVKFKLFQEQNGVCLYSGKNLDISRLFEAGYVDVDHIIPYSISFDDSYSNKVLVLAGENRQKGNRIPYQYFGNDRERWNRFETLVGTQIRSFKKRKNLLIRSLGEAQIEGFRQRNL

SEQ ID NO: 5291 - protein, 218 aa, Unknown
  Description of Unknown: uncultivated organism with predicted taxonomy: Bacteroidales
  MG22-1 HNH domain
DLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEEFSHRQL

SEQ ID NO: 5292 - protein, 229 aa, Unknown
  Description of Unknown: uncultivated organism with predicted taxonomy: Bacteroidales
  MG22-3 HNH domain
DLKNTAEQRARIMRRNRENEMTNFRIKLLLQELHDCQPDIEGIRPYSPSQQELLRLYEETVWESESGKLGGKEASKDIPDDIKKIRDLLSKPSDKPIPQSAIQRYRLWLDQKYLSPYTGRPIPLARLFTADYEIEHIIPRSIFFDDSYANKVICESAVNKLKNNRLGMQFIREMDGRVETVKLGEGRETSILSVDGYVDLVNDLFRNNPRKRNNLLAEEITEDFCHRQL

SEQ ID NO: 5293 - protein, 229 aa, Unknown; identical to SEQ ID NO: 5292
  Description of Unknown: uncultivated organism with predicted taxonomy: Bacteroidales
  MG22-4 HNH domain

SEQ ID NO: 5294 - protein, 218 aa, Unknown
  Description of Unknown: uncultivated organism with predicted taxonomy: Bacteroidales
  MG22-5 HNH domain
DLKNTAEERSRIFRRNSENEDTNFRIKLLLEEFYANEKDIIDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5295 - protein, 218 aa, Unknown
  Description of Unknown: uncultivated organism with predicted taxonomy: Bacteroidales
  MG22-6 HNH domain
DLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQL

SEQ ID NO: 5296 - protein, 218 aa, Unknown; identical to SEQ ID NO: 5294
  Description of Unknown: uncultivated organism with predicted taxonomy: Prevotella
  MG22-7 HNH domain

SEQ ID NO: 5297 - protein, 218 aa, Unknown; identical to SEQ ID NO: 5295
  Description of Unknown: uncultivated organism with predicted taxonomy: Bacteroidales
  MG22-8 HNH domain

SEQ ID NO: 5298 - protein, 218 aa, Unknown
  Description of Unknown: uncultivated organism with predicted taxonomy: Bacteroidales
  MG22-9 HNH domain
DLKNTAEERSRIFRRNSENEDTNFRIKLLLEEFYTNEEDMEGIRPYSPSQQELLRIYEEGVWQQEKEIPQDIKDIKKKLSSDKDINEITHSDVQRYRIWMDQKYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQL

SEQ ID NO: 5299 - protein, 218 aa, Unknown
  Description of Unknown: uncultivated organism with predicted taxonomy: Bacteroidales
  MG22-10 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5300 - protein, 179 aa, Unknown
  Description of Unknown: uncultivated organism with predicted taxonomy: Prevotella
  MG22-11 HNH domain
DLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVL

SEQ ID NO: 5301 - protein, 218 aa, Unknown; identical to SEQ ID NO: 5299
  Description of Unknown: uncultivated organism with predicted taxonomy: Prevotella sp. MGM2
  MG22-12 HNH domain

SEQ ID NO: 5302 - protein, 218 aa, Unknown
  Description of Unknown: uncultivated organism with predicted taxonomy: Prevotella
  MG22-13 HNH domain
DLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQL

SEQ ID NO: 5303 - protein, 23 aa, Unknown
  Description of Unknown: uncultivated organism with predicted taxonomy: Bacteroides ndongoniae
  MG22-14 HNH domain
DLKNTAEERSRIFRRNSENEDTN

SEQ ID NO: 5304 - protein, 218 aa, Unknown
  Description of Unknown: uncultivated organism with predicted taxonomy: Prevotella sp. MGM2
  MG22-15 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQL

SEQ ID NO: 5305 - protein, 218 aa, Unknown
  Description of Unknown: uncultivated organism with predicted taxonomy: Prevotella sp. MGM2
  MG22-16 HNH domain
DLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQL

SEQ ID NO: 5306 - protein, 218 aa, Unknown; identical to SEQ ID NO: 5304
  Description of Unknown: uncultivated organism with predicted taxonomy: Prevotella
  MG22-17 HNH domain

SEQ ID NO: 5307 - protein, 218 aa, Unknown; identical to SEQ ID NO: 5305
  Description of Unknown: uncultivated organism with predicted taxonomy: Bacteroidales
  MG22-18 HNH domain

SEQ ID NO: 5308 - protein, 218 aa, Unknown; identical to SEQ ID NO: 5299
  Description of Unknown: uncultivated organism with predicted taxonomy: Prevotella
  MG22-19 HNH domain

SEQ ID NO: 5309 - protein, 163 aa, Unknown
  Description of Unknown: uncultivated organism with predicted taxonomy: Prevotella sp. MGM2
  MG22-20 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIM

SEQ ID NO: 5310 - protein, 218 aa, Unknown; identical to SEQ ID NO: 5299
  Description of Unknown: uncultivated organism with predicted taxonomy: Bacteroidales
  MG22-21 HNH domain

SEQ ID NO: 5311 - protein, 218 aa, Unknown; identical to SEQ ID NO: 5302
  Description of Unknown: uncultivated organism with predicted taxonomy: Bacteroidales
  MG22-22 HNH domain

SEQ ID NO: 5312 - protein, 217 aa, Unknown
  Description of Unknown: uncultivated organism with predicted taxonomy: Bacteroidales
  MG22-23 HNH domain
DLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQL

SEQ ID NO: 5313 - protein, 218 aa, Unknown
  Description of Unknown: uncultivated organism with predicted taxonomy: Bacteroidales
  MG22-24 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLANEITEEFSHRQL

SEQ ID NO: 5314 - protein, 218 aa, Unknown; identical to SEQ ID NO: 5299
  Description of Unknown: uncultivated organism with predicted taxonomy: Prevotella sp. MGM2
  MG22-25 HNH domain

SEQ ID NO: 5315 - protein, 218 aa, Unknown
  Description of Unknown: uncultivated organism with predicted taxonomy: Bacteroidales
  MG22-26 HNH domain
DLKNTAEERSRIFRRNNENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5316 - protein, 218 aa, Unknown; identical to SEQ ID NO: 5299
  Description of Unknown: uncultivated organism with predicted taxonomy: Prevotella sp. MGM2
  MG22-27 HNH domain

SEQ ID NO: 5317 - protein, 218 aa, Unknown; identical to SEQ ID NO: 5304
  Description of Unknown: uncultivated organism with predicted taxonomy: Bacteroidales
  MG22-28 HNH domain

SEQ ID NO: 5318 - protein, 218 aa, Unknown; identical to SEQ ID NO: 5299
  Description of Unknown: uncultivated organism with predicted taxonomy: Bacteroidales
  MG22-29 HNH domain

SEQ ID NO: 5319 - protein, 206 aa, Unknown
  Description of Unknown: uncultivated organism with predicted taxonomy: Prevotella sp. MGM2
  MG22-30 HNH domain
FRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQL

SEQ ID NO: 5320 - protein, 218 aa, Unknown; identical to SEQ ID NO: 5299
  Description of Unknown: uncultivated organism with predicted taxonomy: Bacteroidales
  MG22-31 HNH domain

SEQ ID NO: 5321 - protein, 47 aa, Unknown
  Description of Unknown: uncultivated organism with predicted taxonomy: Bacteroidales
  MG22-32 HNH domain
DLKNSAAERAKISNRNKQNEGTNFRIKLLLQEFSQYEKDIEGIRRAL

SEQ ID NO: 5322 - protein, 218 aa, Unknown; identical to SEQ ID NO: 5299
  Description of Unknown: uncultivated organism with predicted taxonomy: Bacteroidales
  MG22-33 HNH domain

SEQ ID NO: 5323 - protein, 216 aa, Unknown
  Description of Unknown: uncultivated organism with predicted taxonomy: Bacteroidales
  MG22-34 HNH domain
DLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQL

SEQ ID NO: 5324 - protein, 216 aa, Unknown; identical to SEQ ID NO: 5323
  Description of Unknown: uncultivated organism with predicted taxonomy: Parabacteroides sp. An277
  MG22-35 HNH domain

SEQ ID NO: 5325 - protein, 217 aa, Unknown
  Description of Unknown: uncultivated organism with predicted taxonomy: Bacteroidales
  MG22-36 HNH domain
DLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMTFIQESGGQIIPLGNGRNVQVLNESAYVEFINKTFKHNARKRSLMLADEITEEFCHRQL

SEQ ID NO: 5326 - protein, 218 aa, Unknown
  Description of Unknown: uncultivated organism with predicted taxonomy: Bacteroidales
  MG22-37 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDTYNNKVICESAVNKDKNNRLGMEYIMAAGGKTIELGNGKNVQILKEEEYVELVDKIFGNNTRKRNIMLADEITEDFSHRQL

SEQ ID NO: 5327 - protein, 218 aa, Unknown; identical to SEQ ID NO: 5299
  Description of Unknown: uncultivated organism with predicted taxonomy: Prevotella
  MG22-38 HNH domain

SEQ ID NO: 5328 - protein, 218 aa, Unknown
  Description of Unknown: uncultivated organism with predicted taxonomy: Prevotella sp. MGM2
  MG22-39 HNH domain
DLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5329 - protein, 216 aa, Unknown
  Description of Unknown: uncultivated organism with predicted taxonomy: Bacteroidales
  MG22-40 HNH domain
DLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLSESAYVEFINKTFKHNARKRSLMLADEITEEFCHRQL

SEQ ID NO: 5330 - protein, 218 aa, Unknown
  Description of Unknown: uncultivated organism with predicted taxonomy: Bacteroidales
  MG22-41 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQL

SEQ ID NO: 5331 - protein, 218 aa, Unknown; identical to SEQ ID NO: 5313
  Description of Unknown: uncultivated organism with predicted taxonomy: Prevotella
  MG22-42 HNH domain

SEQ ID NO: 5332 - protein, 218 aa, Unknown
  Description of Unknown: uncultivated organism with predicted taxonomy: Bacteroidales
  MG22-43 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKDVQILKEEEYVELVDKIFGNNTRKRNIMLADEITEEFSHRQL

SEQ ID NO: 5333 - protein, 218 aa, Unknown; identical to SEQ ID NO: 5299
  Description of Unknown: uncultivated organism with predicted taxonomy: Bacteroidales
  MG22-44 HNH domain

SEQ ID NO: 5334 - protein, 218 aa, Unknown
  Description of Unknown: uncultivated organism with predicted taxonomy: Bacteroidales
  MG22-45 HNH domain
DLKNTAEERSRIFRRNSENEDTNFRIKLLLEEFNANEKDIKDVRPYSPSQQELLHIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQL

SEQ ID NO: 5335 - protein, 216 aa, Unknown; identical to SEQ ID NO: 5323
  Description of Unknown: uncultivated organism with predicted taxonomy: Bacteroidales
  MG22-46 HNH domain

SEQ ID NO: 5336 - protein, 218 aa, Unknown
  Description of Unknown: uncultivated organism with predicted taxonomy: Bacteroidales
  MG22-47 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLADEITEEFSHRQL

SEQ ID NO: 5337 - protein, 216 aa, Unknown; identical to SEQ ID NO: 5323
  Description of Unknown: uncultivated organism with predicted taxonomy: Bacteroidales
  MG22-48 HNH domain

SEQ ID NO: 5338 - protein, 218 aa, Unknown; identical to SEQ ID NO: 5299
  Description of Unknown: uncultivated organism with predicted taxonomy: Bacteroidales
  MG22-49 HNH domain

SEQ ID NO: 5339 - protein, 218 aa, Unknown
  Description of Unknown: uncultivated organism with predicted taxonomy: Bacteroidales
  MG22-50 HNH domain
DLKNTAEERSRIFRRNSENEDTNFRIKLLLEEFYANEKDIKDVRPYSPSQQELLRIYEEGVWQKEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5340 - protein, 217 aa, Unknown
  Description of Unknown: uncultivated organism with predicted taxonomy: Prevotellaceae
  MG22-51 HNH domain
DLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQL

SEQ ID NO: 5341 - protein, 168 aa, Unknown
  Description of Unknown: uncultivated organism with predicted taxonomy: Prevotella sp. MGM2
  MG22-52 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLYNPQNEAFRLS

SEQ ID NO: 5342 - protein, 218 aa, Unknown
  Description of Unknown: uncultivated organism with predicted taxonomy: Bacteroidales
  MG22-53 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLTDEITEEFSHRQL

SEQ ID NO: 5343 - protein, 218 aa, Unknown
  Description of Unknown: uncultivated organism with predicted taxonomy: Bacteroidales
  MG22-54 HNH domain
DLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQL

SEQ ID NO: 5344 - protein, 218 aa, Unknown; identical to SEQ ID NO: 5343
  Description of Unknown: uncultivated organism with predicted taxonomy: Bacteroidales
  MG22-55 HNH domain

SEQ ID NO: 5345 - protein, 218 aa, Unknown
  Description of Unknown: uncultivated organism with predicted taxonomy: Bacteroidales
  MG22-56 HNH domain
DLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQL

SEQ ID NO: 5346 - protein, 218 aa, Unknown
  Description of Unknown: uncultivated organism with predicted taxonomy: Bacteroidales
  MG22-57 HNH domain
DLKNTAEERSRIFRRNSENEDTNFRIKLLLEEFNANEKDIKDVRPYSPSRQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5347 - protein, 218 aa, Unknown; identical to SEQ ID NO: 5299
  Description of Unknown: uncultivated organism with predicted taxonomy: Bacteroidales
  MG22-58 HNH domain

SEQ ID NO: 5348 - protein, 218 aa, Unknown; identical to SEQ ID NO: 5302
  Description of Unknown: uncultivated organism with predicted taxonomy: Bacteroidales
  MG22-59 HNH domain

SEQ ID NO: 5349 - protein, 218 aa, Unknown; identical to SEQ ID NO: 5299
  Description of Unknown: uncultivated organism with predicted taxonomy: Bacteroidales
  MG22-60 HNH domain

SEQ ID NO: 5350 - protein, 218 aa, Unknown
  Description of Unknown: uncultivated organism with predicted taxonomy: Bacteroidales
  MG22-61 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILMEEEYVELVDKIFGNNTRKRNIMLADEITEEFSHRQL

SEQ ID NO: 5351 - protein, 218 aa, Unknown; identical to SEQ ID NO: 5299
  Description of Unknown: uncultivated organism with predicted taxonomy: Bacteroidales
  MG22-62 HNH domain

SEQ ID NO: 5352 - protein, 155 aa, Unknown
  Description of Unknown: uncultivated organism with predicted taxonomy: Parabacteroides
  MG22-63 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNN

SEQ ID NO: 5353 - protein, 218 aa, Unknown
  Description of Unknown: uncultivated organism with predicted taxonomy: Prevotella sp. MGM2
  MG22-64 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5354 - protein, 218 aa, Unknown; identical to SEQ ID NO: 5353
  Description of Unknown: uncultivated organism with predicted taxonomy: Prevotella
  MG22-65 HNH domain

SEQ ID NO: 5355 - protein, 218 aa, Unknown; identical to SEQ ID NO: 5299
  Description of Unknown: uncultivated organism with predicted taxonomy: Prevotella sp. MGM2
  MG22-66 HNH domain

SEQ ID NO: 5356 - protein, 180 aa, Unknown
  Description of Unknown: uncultivated organism with predicted taxonomy: Bacteroidales
  MG22-67 HNH domain
DLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTAKRYHCPVFSPPTTKSNTSFRVHGILTTPIIIRSSAKLPSTKTKTTDWAWNTSWLLEEKRLNSATGKTFKF

SEQ ID NO: 5357 - protein, 218 aa, Unknown; identical to SEQ ID NO: 5299
  Description of Unknown: uncultivated organism with predicted taxonomy: Bacteroidales
  MG22-68 HNH domain

SEQ ID NO: 5358 - protein, 218 aa, Unknown; identical to SEQ ID NO: 5353
  Description of Unknown: uncultivated organism with predicted taxonomy: Bacteroidales
  MG22-69 HNH domain

SEQ ID NO: 5359 - protein, 218 aa, Unknown; identical to SEQ ID NO: 5299
  Description of Unknown: uncultivated organism with predicted taxonomy: Bacteroidales
  MG22-70 HNH domain

SEQ ID NO: 5360 - protein, 217 aa, Unknown; identical to SEQ ID NO: 5340
  Description of Unknown: uncultivated organism with predicted taxonomy: Bacteroidales
  MG22-71 HNH domain

SEQ ID NO: 5361 - protein, 218 aa, Unknown
  Description of Unknown: uncultivated organism with predicted taxonomy: Bacteroidales
  MG22-72 HNH domain
DLKNTAEERSRIFRRNSENEDTNFRIKLLLEKFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5362 - protein, 218 aa, Unknown; identical to SEQ ID NO: 5305
  Description of Unknown: uncultivated organism with predicted taxonomy: Prevotella sp. MGM2
  MG22-73 HNH domain

SEQ ID NO: 5363 - protein, 218 aa, Unknown; identical to SEQ ID NO: 5305
  Description of Unknown: uncultivated organism with predicted taxonomy: Bacteroidales
  MG22-74 HNH domain

SEQ ID NO: 5364 - protein, 218 aa, Unknown
  Description of Unknown: uncultivated organism with predicted taxonomy: Bacteroidales
  MG22-75 HNH domain
DLKNTAEERARISKRNSENEDTNFRIKLLLKEFYTNEEDMEGIRPYSPSQQELLRIYEEGVWQQEKEIPQDIKDIKKKLSSDKDINEITHSDVQRYRIWMDQEYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQL

SEQ ID NO: 5365 - protein, 218 aa, Unknown
  Description of Unknown: uncultivated organism with predicted taxonomy: Bacteroidales
  MG22-76 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEDFSHRQL

SEQ ID NO: 5366 - protein, 218 aa, Unknown; identical to SEQ ID NO: 5299
  Description of Unknown: uncultivated organism with predicted taxonomy: Prevotella
  MG22-77 HNH domain

SEQ ID NO: 5367 - protein, 218 aa, Unknown; identical to SEQ ID NO: 5302
  Description of Unknown: uncultivated organism with predicted taxonomy: Bacteroidales
  MG22-78 HNH domain

SEQ ID NO: 5368 - protein, 218 aa, Unknown
  Description of Unknown: uncultivated organism with predicted taxonomy: Bacteroidales
  MG22-79 HNH domain
DLKNTAEERSRIFRRNSENEDTNFRIKLLLEEFYANEKDIKDVRPYSPSQQELLRIYEEGVWQQEKDIPQDIKDIRKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQL

SEQ ID NO: 5369 - protein, 218 aa, Unknown; identical to SEQ ID NO: 5299
  Description of Unknown: uncultivated organism with predicted taxonomy: Bacteroidales
  MG22-80 HNH domain

SEQ ID NO: 5370 - protein, 217 aa, Unknown; identical to SEQ ID NO: 5340
  Description of Unknown: uncultivated organism with predicted taxonomy: Bacteroidales
  MG22-81 HNH domain

SEQ ID NO: 5371 - protein, 218 aa, Unknown; identical to SEQ ID NO: 5353
  Description of Unknown: uncultivated organism with predicted taxonomy: Prevotella
  MG22-82 HNH domain

SEQ ID NO: 5372 - protein, 218 aa, Unknown; identical to SEQ ID NO: 5353
  Description of Unknown: uncultivated organism with predicted taxonomy: Prevotella
  MG22-83 HNH domain

SEQ ID NO: 5373 - protein, 218 aa, Unknown; identical to SEQ ID NO: 5330
  Description of Unknown: uncultivated organism with predicted taxonomy: Bacteroidales
  MG22-84 HNH domain

SEQ ID NO: 5374 - protein, 218 aa, Unknown; identical to SEQ ID NO: 5299
  Description of Unknown: uncultivated organism with predicted taxonomy: Prevotella
  MG22-85 HNH domain

SEQ ID NO: 5375 - protein, 218 aa, Unknown
  Description of Unknown: uncultivated organism with predicted taxonomy: Bacteroidales
  MG22-86 HNH domain
DLKNTAEERSRIFRRNSENEETNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAINKDKNNRLGMEYIMAAGGKTIELGNGKDVQILKEEEYVELVDKIFGNNTRKRNIMLADEITEEFSHRQL

SEQ ID NO: 5376 - protein, 218 aa, Unknown
  Description of Unknown: uncultivated organism with predicted taxonomy: Prevotella sp. MGM2
  MG22-87 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSQRQL

SEQ ID NO: 5377 - protein, 218 aa, Unknown
  Description of Unknown: uncultivated organism with predicted taxonomy: Prevotella sp. MGM2
  MG22-88 HNH domain
DLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQL

SEQ ID NO: 5378 - protein, 218 aa, Unknown
  Description of Unknown: uncultivated organism with predicted taxonomy: Prevotella sp. MGM2
  MG22-89 HNH domain
DLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQL

SEQ ID NO: 5379 - protein, 218 aa, Unknown; identical to SEQ ID NO: 5304
  Description of Unknown: uncultivated organism with predicted taxonomy: Bacteroidales
  MG22-90 HNH domain

SEQ ID NO: 5380 - protein, 218 aa, Unknown; identical to SEQ ID NO: 5377
  Description of Unknown: uncultivated organism with predicted taxonomy: Prevotella
  MG22-91 HNH domain

SEQ ID NO: 5381 - protein, 218 aa, Unknown; identical to SEQ ID NO: 5302
  Description of Unknown: uncultivated organism with predicted taxonomy: Bacteroidales
  MG22-92 HNH domain

SEQ ID NO: 5382 - protein, 217 aa, Unknown
  Description of Unknown: uncultivated organism with predicted taxonomy: Prevotella
  MG22-94 HNH domain
NMRATAKERQKTSQLQLENEQANLRIKALLQEFMNPEFEVEDVRPYSPSQQELLRIYEGTVLEQEAGHIDEPIREIIRKFSQTDAAKRPTTSEVLRYKLWLEQKYRSPYTGEVIPLGKLFTPAYQIEHVIPQSLYYDNSFNNKVICEAEVNLLKGNQLGMPFIMRHANEKVVCSMGKQVKIFTPEAYRLFVEEHYRGRKMTILLSEEIPTAFNDRQK

SEQ ID NO: 5383 - protein, 227 aa, Unknown
  Description of Unknown: uncultivated organism with predicted taxonomy: Bacteroidales
  MG22-95 HNH domain
SVKQNKEQRERAMTQMAENERRNLRLRAMLEAFLNDRDPIGFDPDANINPGSPNQQLKLRLFEDTAFSYAQANGDDQVEEMLNIRNSITGGSDEKSATPAQIRRYALWLEQNFRSPYTGATISLARLFTDDYQVDHIIPQALYWDDSFNNKVLCEGGVNNTKSNALAFDFIAAHQGETIALPNGRKVTILSMEQYQELVLATYKNNRAKCEKLLMKEIPAEFTQRQL

SEQ ID NO: 5384 - protein, 219 aa, Unknown
  Description of Unknown: uncultivated organism with predicted taxonomy: Bacteroidales
  MG22-96 HNH domain
NLNQTAEQRKRDTERNLGNERANLRAKILLTEFLNPEMNVENVRPYSPSQLELLRIFEEGILDDSAGNMPDDIQEIIKKLDSTDIKRRPTESEVLRYRNWLEQGYRSPYTNEIIPLSKLFTTAYQIEHIIPQSLYFNNSYNNKVICEAEVNQLKSNQLGMEFVKNHGGEIVECAFGRKVRILTPEEYTAFVEQHYKHNVHKKNNLLSTELPSEFSSRQL

SEQ ID NO: 5385 - protein, 219 aa, Unknown
  Description of Unknown: uncultivated organism with predicted taxonomy: Bacteroidetes
  MG22-97 HNH domain
NLNQTAEQRKRDTERNLGNERANLRAKILLTEFLNPEMNVENVRPYSPSQQELLRIFEEGIIDDSTGNMPDDIQEIIKKLDSSDIKRRPTESEILRYRNWLEQGYRSPYTNEIIPLSKLFTPAYQIEHIIPQSLYFNNSYNNKVICETEVNQLKSNQLGMEFVKNHGGEIVECAFGRKVRILTPEEYTAFVEQHYKHNIHKKNNLLSTELPSEFSSRQL

SEQ ID NO: 5386 - protein, 176 aa, Unknown
  Description of Unknown: uncultivated organism with predicted taxonomy: Bacteroidales
  MG22-98 HNH domain
SMKQTSQQRKADNERMQSNYKRNQEVRDKIAEELQQNATNGERPKIGAKKIASYKIWEDQKGRSPYTGKAISDAALLNADGRYDIDHVIPQSRYYDDSLNNKVICEKEVNLKKGNMLGLEFIQKHGGETIQLSSGGEVTILREEEDKKLVNETFKGRKQKIMLMTETPNDFTNRQK

SEQ ID NO: 5387 - protein, 220 aa, Unknown
  Description of Unknown: uncultivated organism with predicted taxonomy: Flavobacteriales
  MG22-99 HNH domain
DMRKTAQERKRDSERNSQNFKARQRIKMLLDEFEKMRIDDVHPYSPMHQEKLRIVEDGVFDRVSAKGDEKSKEMLKDMRAFQTNVEKNNVTPGDISRYMLYLEQNYRSPYTNETISMKRLFSSDYEIEHVIPRSRFFDDSMSNKVICEAKVNKEKGNMTGMEFIMKRGGEKIELGEGREVTIVNEKDYRQYVDEVYKNNSRKRKNLLSEDIPGGFSNSQM

SEQ ID NO: 5388 - protein, 217 aa, Unknown
  Description of Unknown: uncultivated organism with predicted taxonomy: Bacteroidales
  MG22-100 HNH domain
EMRATAKEREERSARQLRNEQTNLRIKALLQEFMNPALEIEDVRPYSPSQQELLHIYEETVLEQEAGNIDDDIREIIRKFTQTEASKRPTEGEVRRYKLWLEQRYRSPYTGKNIPLGKLFTPAYQIEHVIPQSVYYDNSYNNKVICEAEVNLLKGNMLGMAFIKEHAGEIVPLSLGGEVEILKPDTYREFVEEHYKGRKRQIMLSEEIPTEFTSRQM

SEQ ID NO: 5389 - protein, 217 aa, Unknown
  Description of Unknown: uncultivated organism with predicted taxonomy: Bacteroidales
  MG22-101 HNH domain
EMRATAKERESRHNRQLENEQTNLRIKALLQEFMNPEFGIEDVRPYSPNQQELLRIYEDTVLSQEAGRVDEPIREIIRKFSQTDAAKRPTTAEVLRYKLWLEQKYRSPYTGEPISLSKIFTSAYQIEHVIPQSVYYDNSYSNKVICEAEVNLLKGNMLGMPFIMQHAGEKVQCSVGNIVTISTPEAYRAFVEEHYKGKKQKILLSEEIPTNFTARQM

SEQ ID NO: 5390 - protein, 164 aa, Unknown
  Description of Unknown: uncultivated organism with predicted taxonomy: Clostridia
  MG23-1 HNH domain
EDGEKGARTVSRKKKLLDLYDAIKHEERELAKVFSDEIDSKTEADFRSKKLYLYYLQQGRCMYSGDIIHLSDLMNDNLYDIDHIYPRHFIKDDSLENNLVLVKKQINNRKQDTFPIERSIQEDMRPFWKSLADSGFISAEKYKRLTRRDAFTDEEKAAFISRQL

SEQ ID NO: 5391 - protein, 162 aa, Unknown
  Description of Unknown: uncultivated organism with predicted taxonomy: Firmicutes
  MG23-3 HNH domain
DDAQTKAKNKGKRTKSRKDFLLECYKDDKAWKDELTSVDDGELRAKKLYLYYLQMGRCMYSGEAIDLASLMSGNTMYDIDHIHPRHFVKDDSLENNLVLVKKDKNAHKSDNYPLESEIRNKQFGFWKSLLDKGLITKTKFTRLIRSEDFSPEELAGFINRQL

SEQ ID NO: 5392 - protein, 160 aa, Unknown
  Description of Unknown: uncultivated organism with predicted taxonomy: Clostridiales
  MG23-4 HNH domain
EDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQL

SEQ ID NO: 5393 - protein, 166 aa, Unknown
  Description of Unknown: uncultivated organism with predicted taxonomy: Firmicutes
  MG23-5 HNH domain
DSAQTRARNKGKRTQSRKEFLLNVYKEDKEWRKEIQSCEEIKFRKKKIYLYYLQHGKSLYSGKTIDFDTLLSDNDAYDIDHIYPRHFVKDDSLENNLVLCLKSENAKKGDQYPLRKTFDSAVLSSQEGVWKSLLKQKVITKEKYDRLVRTADFTIDELAGFINRQL

SEQ ID NO: 5394 - protein, 162 aa, Unknown
  Description of Unknown: uncultivated organism with predicted taxonomy: Clostridiales
  MG23-6 HNH domain
DSAQTRARNKGKRTQSRKDFLINAYKEDKEWRKEIESRDEAEFRIKKLYLYYVQMGRCMYSGEAIDLHALMAGNEQYDIDHIYPRHFVKDDSLENNLVLVKKTINAHKSDTFPLEAELRKKQYAFWRSLLDRGLITQNKFNRLTRATGFSNEELAGFINRQL

SEQ ID NO: 5395 - protein, 160 aa, Unknown; identical to SEQ ID NO: 5392
  Description of Unknown: uncultivated organism with predicted taxonomy: Clostridiales
  MG23-7 HNH domain

SEQ ID NO: 5396 - protein, 160 aa, Unknown; identical to SEQ ID NO: 5392
  Description of Unknown: uncultivated organism with predicted taxonomy: Clostridiales
  MG23-8 HNH domain

SEQ ID NO: 5397 - protein, 160 aa, Unknown; identical to SEQ ID NO: 5392
  Description of Unknown: uncultivated organism with predicted taxonomy: Clostridiales
  MG23-9 HNH domain

SEQ ID NO: 5398 - protein, 165 aa, Unknown
  Description of Unknown: uncultivated organism with predicted taxonomy: Clostridiales
  MG23-10 HNH domain
EHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5399 - protein, 164 aa, Unknown
  Description of Unknown: uncultivated organism with predicted taxonomy: Butyrivibrio sp. CAG:318
  MG23-11 HNH domain
EHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQL

SEQ ID NO: 5400 - protein, 164 aa, Unknown
  Description of Unknown: uncultivated organism with predicted taxonomy: Butyrivibrio sp. CAG:318
  MG23-12 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQL

SEQ ID NO: 5401 - protein, 165 aa, Unknown
  Description of Unknown: uncultivated organism with predicted taxonomy: Clostridium sp. AF36-4
  MG23-13 HNH domain
EHESGNERKASRKKKMLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5402 - protein, 164 aa, Unknown
  Description of Unknown: uncultivated organism with predicted taxonomy: Butyrivibrio sp. CAG:318
  MG23-14 HNH domain
EHGKENDRKTSRKKKILDLYSALKREKKEWAELKIREIEGRTEADFRIKKLYLYYLQQGRCMYSGEKIELNDLFNNNLYDIDHIYPRHFIKDDSLENNLVLVKKEINNHKSDNYPLESDIRKNMNEFWKSLREKNFISKEKYSRLIRTEEFTDEEKAAFISRQL

SEQ ID NO: 5403 - protein, 164 aa, Unknown
  Description of Unknown: uncultivated organism with predicted taxonomy: Butyrivibrio sp. CAG:318
  MG23-15 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQL

SEQ ID NO: 5404 - protein, 165 aa, Unknown; identical to SEQ ID NO: 5401
  Description of Unknown: uncultivated organism with predicted taxonomy: Clostridium sp. AF36-4
  MG23-16 HNH domain

SEQ ID NO: 5405 - protein, 164 aa, Unknown
  Description of Unknown: uncultivated organism with predicted taxonomy: Butyrivibrio sp. CAG:318
  MG23-17 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQL

SEQ ID NO: 5406 - protein, 165 aa, Unknown
  Description of Unknown: uncultivated organism with predicted taxonomy: Clostridiales
  MG23-18 HNH domain
EHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5407 - protein, 164 aa, Unknown; identical to SEQ ID NO: 5402
  Description of Unknown: uncultivated organism with predicted taxonomy: Butyrivibrio sp. CAG:318
  MG23-19 HNH domain

SEQ ID NO: 5408 - protein, 164 aa, Unknown; identical to SEQ ID NO: 5399
  Description of Unknown: uncultivated organism with predicted taxonomy: Butyrivibrio sp. CAG:318
  MG23-20 HNH domain

SEQ ID NO: 5409 - protein, 164 aa, Unknown
  Description of Unknown: uncultivated organism with predicted taxonomy: Butyrivibrio sp. CAG:318
  MG23-21 HNH domain
EHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESDIRKNMNEFWKSLREKNFISKEKYSRLIRTEEFTDEEKAAFISRQL

SEQ ID NO: 5410 - protein, 164 aa, Unknown; identical to SEQ ID NO: 5399
  Description of Unknown: uncultivated organism with predicted taxonomy: Butyrivibrio sp. CAG:318
  MG23-22 HNH domain

SEQ ID NO: 5411 - protein, 164 aa, Unknown; identical to SEQ ID NO: 5405
  Description of Unknown: uncultivated organism with predicted taxonomy: Butyrivibrio sp. CAG:318
  MG23-23 HNH domain

SEQ ID NO: 5412 - protein, 165 aa, Unknown
  Description of Unknown: uncultivated organism with predicted taxonomy: Clostridiales
  MG23-24 HNH domain
EHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5413 - protein, 164 aa, Unknown
  Description of Unknown: uncultivated organism with predicted taxonomy: Butyrivibrio sp. CAG:318
  MG23-25 HNH domain
EHGKENDRKASRKKKLLDLYSALKRENKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQL

SEQ ID NO: 5414 - protein, 164 aa, Unknown; identical to SEQ ID NO: 5399
  Description of Unknown: uncultivated organism with predicted taxonomy: Butyrivibrio sp. CAG:318
  MG23-26 HNH domain

SEQ ID NO: 5415 - protein, 164 aa, Unknown; identical to SEQ ID NO: 5399
  Description of Unknown: uncultivated organism with predicted taxonomy: Butyrivibrio sp. CAG:318
  MG23-27 HNH domain

SEQ ID NO: 5416 - protein, 164 aa, Unknown; identical to SEQ ID NO: 5405
  Description of Unknown: uncultivated organism with predicted taxonomy: Butyrivibrio sp. CAG:318
  MG23-28 HNH domain

SEQ ID NO: 5417 - protein, 164 aa, Unknown; identical to SEQ ID NO: 5399
  Description of Unknown: uncultivated organism with predicted taxonomy: Butyrivibrio sp. CAG:318
  MG23-29 HNH domain

SEQ ID NO: 5418 - protein, 164 aa, Unknown; identical to SEQ ID NO: 5403
  Description of Unknown: uncultivated organism with predicted taxonomy: Butyrivibrio sp. CAG:318
  MG23-30 HNH domain

SEQ ID NO: 5419 - protein, 164 aa, Unknown; identical to SEQ ID NO: 5399
  Description of Unknown: uncultivated organism with predicted taxonomy: Butyrivibrio sp. CAG:318
  MG23-31 HNH domain

SEQ ID NO: 5420 - protein, 164 aa, Unknown
  Description of Unknown: uncultivated organism with predicted taxonomy: Butyrivibrio sp. CAG:318
  MG23-32 HNH domain
EHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQL

SEQ ID NO: 5421 - protein, 165 aa, Unknown; identical to SEQ ID NO: 5406
  Description of Unknown: uncultivated organism with predicted taxonomy: Clostridiales
  MG23-33 HNH domain

SEQ ID NO: 5422 - protein, 164 aa, Unknown; identical to SEQ ID NO: 5405
  Description of Unknown: uncultivated organism with predicted taxonomy: Butyrivibrio sp. CAG:318
  MG23-34 HNH domain

SEQ ID NO: 5423 - protein, 164 aa, Unknown
  Description of Unknown: uncultivated organism with predicted taxonomy: Butyrivibrio sp. CAG:318
  MG23-35 HNH domain
EHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQL

SEQ ID NO: 5424 - protein, 165 aa, Unknown
  Description of Unknown: uncultivated organism with predicted taxonomy: Clostridiales
  MG23-36 HNH domain
EHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5425 - protein, 165 aa, Unknown; identical to SEQ ID NO: 5412
  Description of Unknown: uncultivated organism with predicted taxonomy: Clostridiales
  MG23-37 HNH domain

SEQ ID NO: 5426 - protein, 164 aa, Unknown; identical to SEQ ID NO: 5399
  Description of Unknown: uncultivated organism with predicted taxonomy: Butyrivibrio sp. CAG:318
  MG23-38 HNH domain

SEQ ID NO: 5427 - protein, 164 aa, Unknown; identical to SEQ ID NO: 5403
  Description of Unknown: uncultivated organism with predicted taxonomy: Butyrivibrio sp. CAG:318
  MG23-39 HNH domain

SEQ ID NO: 5428 - protein, 164 aa, Unknown
  Description of Unknown: uncultivated organism with predicted taxonomy: Butyrivibrio sp. CAG:318
  MG23-40 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQL

SEQ ID NO: 5429 - protein, 165 aa, Unknown; identical to SEQ ID NO: 5406
  Description of Unknown: uncultivated organism with predicted taxonomy: Clostridiales
  MG23-41 HNH domain

SEQ ID NO: 5430 - protein, 164 aa, Unknown; identical to SEQ ID NO: 5420
  Description of Unknown: uncultivated organism with predicted taxonomy: Butyrivibrio sp. CAG:318
  MG23-42 HNH domain

SEQ ID NO: 5431 - protein, 164 aa, Unknown; identical to SEQ ID NO: 5399
  Description of Unknown: uncultivated organism with predicted taxonomy: Butyrivibrio sp. CAG:318
  MG23-43 HNH domain

SEQ ID NO: 5432 - protein, 164 aa, Unknown; identical to SEQ ID NO: 5400
  Description of Unknown: uncultivated organism with predicted taxonomy: Butyrivibrio sp. CAG:318
  MG23-44 HNH domain

SEQ ID NO: 5433 - protein, 164 aa, Unknown; identical to SEQ ID NO: 5399
  Description of Unknown: uncultivated organism with predicted taxonomy: Butyrivibrio sp. CAG:318
  MG23-45 HNH domain

SEQ ID NO: 5434 - protein, 165 aa, Unknown
  Description of Unknown: uncultivated organism with predicted taxonomy: Clostridiales
  MG23-46 HNH domain
EHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIKKDMSGFWKYLCEKKFITKEKYNRLMRTDKFSAEEKAAFVNRQL

SEQ ID NO: 5435 - protein, 164 aa, Unknown; identical to SEQ ID NO: 5428
  Description of Unknown: uncultivated organism with predicted taxonomy: Butyrivibrio sp. CAG:318
  MG23-47 HNH domain

SEQ ID NO: 5436 - protein, 164 aa, Unknown; identical to SEQ ID NO: 5399
  Description of Unknown: uncultivated organism with predicted taxonomy: Butyrivibrio sp. CAG:318
  MG23-48 HNH domain

SEQ ID NO: 5437 - protein, 165 aa, Unknown; identical to SEQ ID NO: 5412
  Description of Unknown: uncultivated organism with predicted taxonomy: Clostridiales
  MG23-49 HNH domain

SEQ ID NO: 5438 - protein, 164 aa, Unknown
  Description of Unknown: uncultivated organism with predicted taxonomy: Clostridiales
  MG23-50 HNH domain
EEGIKNERKNSRKKKLLELYTSIKNEQKAWSEVKIREIDGRTETDFRIKKLYLYYLQHGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQL

SEQ ID NO: 5439 - protein, 165 aa, Unknown
  Description of Unknown: uncultivated organism with predicted taxonomy: Clostridiales
  MG23-51 HNH domain
EHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQL

SEQ ID NO: 5440 - protein, 164 aa, Unknown; identical to SEQ ID NO: 5420
  Description of Unknown: uncultivated organism with predicted taxonomy: Butyrivibrio sp. CAG:318
  MG23-52 HNH domain

SEQ ID NO: 5441 - protein, 164 aa, Unknown; identical to SEQ ID NO: 5399
  Description of Unknown: uncultivated organism with predicted taxonomy: Butyrivibrio sp. CAG:318
  MG23-53 HNH domain

SEQ ID NO: 5442 - protein, 164 aa, Unknown; identical to SEQ ID NO: 5405
  Description of Unknown: uncultivated organism with predicted taxonomy: Butyrivibrio sp. CAG:318
  MG23-54 HNH domain

SEQ ID NO: 5443 - protein, 164 aa, Unknown; identical to SEQ ID NO: 5399
  Description of Unknown: uncultivated organism with predicted taxonomy: Butyrivibrio sp. CAG:318
  MG23-55 HNH domain

SEQ ID NO: 5444 - protein, 164 aa, Unknown; identical to SEQ ID NO: 5405
  Description of Unknown: uncultivated organism with predicted taxonomy: Butyrivibrio sp. CAG:318
  MG23-56 HNH domain

SEQ ID NO: 5445 - protein, 164 aa, Unknown; identical to SEQ ID NO: 5399
  Description of Unknown: uncultivated organism with predicted taxonomy: Butyrivibrio sp. CAG:318
  MG23-57 HNH domain

SEQ ID NO: 5446 - protein, 164 aa, Unknown; identical to SEQ ID NO: 5405
  Description of Unknown: uncultivated organism with predicted taxonomy: Butyrivibrio sp. CAG:318
  MG23-58 HNH domain

SEQ ID NO: 5447 - protein, 165 aa, Unknown; identical to SEQ ID NO: 5406
  Description of Unknown: uncultivated organism with predicted taxonomy: Clostridiales
  MG23-59 HNH domain

SEQ ID NO: 5448 - protein, 165 aa, Unknown
  Description of Unknown: uncultivated organism with predicted taxonomy: Clostridiales
  MG23-60 HNH domain
EHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKATFVNRQL

SEQ ID NO: 5449 - protein, 93 aa, Unknown
  Description of Unknown: uncultivated organism with predicted taxonomy: Clostridiales
  MG23-61 HNH domain
EHENGNERKASRKKKLLDLYKAIKSEQKQWAEQMIAEIDKRDEADFRIKKLYLYYIQQGKCMYSGDTIDLDLLLKNNNIYDIDHIYPRHFIKD

SEQ ID NO: 5450 - protein, 164 aa, Unknown; identical to SEQ ID NO: 5405
  Description of Unknown: uncultivated organism with predicted taxonomy: Butyrivibrio sp. CAG:318
  MG23-62 HNH domain

SEQ ID NO: 5451 - protein, 164 aa, Unknown
  Description of Unknown: uncultivated organism with predicted taxonomy: Butyrivibrio sp. CAG:318
  MG23-63 HNH domain
EHGKENDRKASRKKKLLDLYSTLKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQL

SEQ ID NO: 5452 - protein, 165 aa, Unknown; identical to SEQ ID NO: 5434
  Description of Unknown: uncultivated organism with predicted taxonomy: Clostridiales
  MG23-64 HNH domain

SEQ ID NO: 5453 - protein, 165 aa, Unknown; identical to SEQ ID NO: 5398
  Description of Unknown: uncultivated organism with predicted taxonomy: Clostridiales
  MG23-65 HNH domain

SEQ ID NO: 5454 - protein, 164 aa, Unknown; identical to SEQ ID NO: 5423
  Description of Unknown: uncultivated organism with predicted taxonomy: Butyrivibrio sp. CAG:318
  MG23-66 HNH domain

SEQ ID NO: 5455 - protein, 164 aa, Unknown; identical to SEQ ID NO: 5405
  Description of Unknown: uncultivated organism with predicted taxonomy: Butyrivibrio sp. CAG:318
  MG23-67 HNH domain

SEQ ID NO: 5456 - protein, 164 aa, Unknown; identical to SEQ ID NO: 5423
  Description of Unknown: uncultivated organism with predicted taxonomy: Butyrivibrio sp. CAG:318
  MG23-68 HNH domain

SEQ ID NO: 5457 - protein, 164 aa, Unknown
  Description of Unknown: uncultivated organism with predicted taxonomy: Butyrivibrio sp. CAG:318
  MG23-69 HNH domain
EHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQL

SEQ ID NO: 5458 - protein, 164 aa, Unknown; identical to SEQ ID NO: 5405
  Description of Unknown: uncultivated organism with predicted taxonomy: Butyrivibrio sp. CAG:318
  MG23-70 HNH domain

SEQ ID NO: 5459 - protein, 140 aa, Unknown
  Description of Unknown: uncultivated organism with predicted taxonomy: Butyrivibrio sp. YAB3001
  MG23-71 HNH domain
EEGEKGKRTESRKKKLEFLYKGQKQFLQEIGKRDERDFRQKKLYLYYLQNGKSMYTGNEIDLDELLSNNSKYDIDHIYPRHYIKDDSLDNNLVLVEKEINNDIKGGDYPISKTIQSKMRSFWKELQEKGFITSEKYNRLV

SEQ ID NO: 5460 - protein, 164 aa, Unknown
  Description of Unknown: uncultivated organism with predicted taxonomy: Eubacterium
  MG23-72 HNH domain
EEGIKNERKNSRKKKLLELYTSIKNEQKAWSEVKIREIDGRTETDFRIKKLYLYYLQQGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQL

SEQ ID NO: 5461 - RNA, 121 nt, Artificial Sequence
  Description of Artificial Sequence: Synthetic polynucleotide
  MG1-4 sgRNA
  modified_base (1)..(22): a, c, u, g, unknown or other
nnnnnnnnnnnnnnnnnnnnnnguuuugauuuacucgaaagaguccaaucauaauugaccggagaauaauugauuccucuacaauguacgaauaaauucauucucuaaaccuuaaaaauuu

SEQ ID NO: 5462 - RNA, 99 nt, Artificial Sequence
  Description of Artificial Sequence: Synthetic oligonucleotide
  MG1-5 sgRNA
  modified_base (1)..(22): a, c, u, g, unknown or other
nnnnnnnnnnnnnnnnnnnnnnguuuugacuugaaaaagucuuaacugauuuugccgaauuuuaagcucuacguaguaccuuggaauucggcauauuuu

SEQ ID NO: 5463 - RNA, 99 nt, Artificial Sequence
  Description of Artificial Sequence: Synthetic oligonucleotide
  MG1-6 sgRNA
  modified_base (1)..(22): a, c, u, g, unknown or other
nnnnnnnnnnnnnnnnnnnnnnguuuugacuugaaaaagucuuaacugauuuugccgaauuucaagcucugcauugcaccuuggcauucggcauauuuu

SEQ ID NO: 5464 - RNA, 99 nt, Artificial Sequence
  Description of Artificial Sequence: Synthetic oligonucleotide
  MG1-7 sgRNA
  modified_base (1)..(22): a, c, u, g, unknown or other
nnnnnnnnnnnnnnnnnnnnnnguuuugacuuugaaaaaagucuuaacugauuuugccgaauuuuaagcucugcauggcaccuugaaauucggcauuuu

SEQ ID NO: 5465 - RNA, 100 nt, Artificial Sequence
  Description of Artificial Sequence: Synthetic polynucleotide
  MG2-7 sgRNA
  modified_base (1)..(22): a, c, u, g, unknown or other
nnnnnnnnnnnnnnnnnnnnnngcuuugccuuggaaacaagacaaaguuaauuaaggcaguucggaccucuacuuuguacgucaggauagaaagccuuuu

SEQ ID NO: 5466 - RNA, 110 nt, Artificial Sequence
  Description of Artificial Sequence: Synthetic polynucleotide
  MG3-6 sgRNA
  modified_base (1)..(22): a, c, u, g, unknown or other
nnnnnnnnnnnnnnnnnnnnnnguugagaaucgaaagauucuuaauaaggcauccuuccgaugcugacuucucaccguccguuuuccaauaggagcgggcgguauguuuu

SEQ ID NO: 5467 - RNA, 110 nt, Artificial Sequence
  Description of Artificial Sequence: Synthetic polynucleotide
  MG3-7 sgRNA
  modified_base (1)..(22): a, c, u, g, unknown or other
nnnnnnnnnnnnnnnnnnnnnnguugggaaccgaaagguucccaauaaggcgcaucuuggcgcugacuucucaccguccucuugcugcuuagcagagggcgguauguuuu

SEQ ID NO: 5468 - RNA, 124 nt, Artificial Sequence
  Description of Artificial Sequence: Synthetic polynucleotide
  MG4-5 sgRNA
  modified_base (1)..(22): a, c, u, g, unknown or other
nnnnnnnnnnnnnnnnnnnnnngcuguggcuugcgggggaaaccccuugucacaguaagggacuuucguucgcgaaaggcaaccucgccagcaucgcugggcgaggaccagggcaaggcgauuu

SEQ ID NO: 5469 - RNA, 118 nt, Artificial Sequence
  Description of Artificial Sequence: Synthetic polynucleotide
  MG14-1 sgRNA
  modified_base (1)..(22): a, c, u, g, unknown or other
nnnnnnnnnnnnnnnnnnnnnngucuugagcgaaagcuccagacaaggggagccacuuaaguggcuuacccguaaaguaacccccguucaaucuucggauugggcggggcgaacuuuu

SEQ ID NO: 5470 - RNA, 118 nt, Artificial Sequence
  Description of Artificial Sequence: Synthetic polynucleotide
  MG15-1 sgRNA
  modified_base (1)..(22): a, c, u, g, unknown or other
nnnnnnnnnnnnnnnnnnnnnnguuguaauucccuagaaauagguuauuacaauaagguccaacaggaguguugguaccguaaagcucuaacggcacccacgggugccguuaucuuuu

SEQ ID NO: 5471 - RNA, 162 nt, Artificial Sequence
  Description of Artificial Sequence: Synthetic polynucleotide
  MG16-2 sgRNA
  modified_base (1)..(22): a, c, u, g, unknown or other
nnnnnnnnnnnnnnnnnnnnnnguugugaauugcuuuaaauugaaaaauuuaagcaauucacaauaaggauuauuccguugugaaaacauuuaaagcggggucaacagccucgcuuucuuuuugagucuaugagacauuaggucaauaagucuaugaguuuu

SEQ ID NO: 5472 - RNA, 101 nt, Artificial Sequence
  Description of Artificial Sequence: Synthetic polynucleotide
  MG18-1 sgRNA
  modified_base (1)..(22): a, c, u, g, unknown or other
nnnnnnnnnnnnnnnnnnnnnnguuugagaguagugaaaacuacgaguucaaauacaauuuuuucaaauugcccuauagggcccucacagugugagauuuu

SEQ ID NO: 5473 - RNA, 117 nt, Artificial Sequence
  Description of Artificial Sequence: Synthetic polynucleotide
  MG21-1 sgRNA
  modified_base (1)..(22): a, c, u, g, unknown or other
nnnnnnnnnnnnnnnnnnnnnnguuguaguuccccuuuugaaaaaaaguguguuacugcaauaagguaaaacaccacgaagcucugcccuaacugccuuagcaguuagggcaucuuu

SEQ ID NO: 5474 - RNA, 134 nt, Artificial Sequence
  Description of Artificial Sequence: Synthetic polynucleotide
  MG22-1 sgRNA
  modified_base (1)..(22): a, c, u, g, unknown or other
nnnnnnnnnnnnnnnnnnnnnnguugugaauugcuuucaaauuagaaauaauugaaagcaauucgcaauaaggauuauuccguugugaaaacauuucgaguggcuucgugaaauucacgaagucacuucguuuu

SEQ ID NO: 5475 - RNA, 113 nt, Artificial Sequence
  Description of Artificial Sequence: Synthetic polynucleotide
  MG23-1 sgRNA
  modified_base (1)..(22): a, c, u, g, unknown or other
nnnnnnnnnnnnnnnnnnnnnnguuugagaaccugaaaaggugagugcaaauaagguuuaaccgaaauuguuuaccugcauugugcaguauaagaaagaccgcgaggucuuuu

SEQ ID NO: 5476 - RNA, 99 nt, Unknown
  Description of Unknown: uncultivated organism with predicted taxonomy: Candidatus Melainabacteria
  MG1-4 tracrRNA
uaaaauauuuuaaguuaagaguccaaucauaauugaccggagaauaauugauuccucuacaauguacgaauaaauucauucucuaaaccuuaaaaauuu

SEQ ID NO: 5477 - RNA, 72 nt, Unknown
  Description of Unknown: uncultivated organism with predicted taxonomy: Verrucomicrobia
  MG1-5 tracrRNA
uuaguuguaaagucuuaacugauuuugccgaauuuuaagcucuacguaguaccuuggaauucggcauauuuu

SEQ ID NO: 5478 - RNA, 72 nt, Unknown
  Description of Unknown: uncultivated organism with predicted taxonomy: unclassified Verrucomicrobia (miscellaneous)
  MG1-6 tracrRNA
uuuguuguaaagucuuaacugauuuugccgaauuucaagcucugcauugcaccuuggcauucggcauauuuu

SEQ ID NO: 5479 - RNA, 78 nt, Unknown
  Description of Unknown: uncultivated organism with predicted taxonomy: unclassified Verrucomicrobia (miscellaneous)
  MG1-7 tracrRNA
agaaaauuuuuguuguaaagucuuaacugauuuugccgaauuuuaagcucugcauggcaccuugaaauucggcauuuu

SEQ ID NO: 5480 - RNA, 106 nt, Unknown
  Description of Unknown: uncultivated organism
  MG1-1
cucuccggggggagaagucuuaacugauucggcggcguugaaaccacugccuagcacguuucaacgccgcccuuuauucccaaaacucgaccugcuguugaauuuu

SEQ ID NO: 5481 - RNA, 77 nt, Unknown
  Description of Unknown: uncultivated organism with predicted taxonomy: Verrucomicrobia
  MG1-2
gacuuuucuggggagugaagucuuaacugauuuagccccgcagugaccacugcuugcacgucacugcggggccuuuu

SEQ ID NO: 5482 - RNA, 383 nt, Unknown
  Description of Unknown: uncultivated organism
  MG1-3
  modified_base (61)..(62): a, c, u, g, unknown or other
  modified_base (110)..(111): a, c, u, g, unknown or other
  modified_base (177)..(178): a, c, u, g, unknown or other
  modified_base (239)..(240): a, c, u, g, unknown or other
  modified_base (301)..(302): a, c, u, g, unknown or other
  modified_base (363)..(364): a, c, u, g, unknown or other
gauaccggagaauuuugggcuucccugauagccauuucaaaaaggguuugauaggauugunnuauaagguuuguagagcauguugggaauguaucuucaaaagaauuugnnggcguauaaaagaaaaacucagaaacacauuguucugaguuuuuuucugucccgaccguugauugnnuaaagguccuuuuucuuacagacaaacaaugggaaaagucagucaauugcaucggaaaagnnaauaugagcacagcaaaaaacuccucgacccagcacagccggaacucuuugaaauuuggunnaaaggaaagccacgacuggugcuuuucuggaaagcagugcagccguuucuuuccuauucgnnuuaagauuuacccgacucg

SEQ ID NO: 5483 - RNA, 383 nt, Unknown; identical to SEQ ID NO: 5482
  Description of Unknown: uncultivated organism
  MG1-3
  modified_base (61)..(62): a, c, u, g, unknown or other
  modified_base (110)..(111): a, c, u, g, unknown or other
  modified_base (177)..(178): a, c, u, g, unknown or other
  modified_base (239)..(240): a, c, u, g, unknown or other
  modified_base (301)..(302): a, c, u, g, unknown or other
  modified_base (363)..(364): a, c, u, g, unknown or other

SEQ ID NO: 5484 - RNA, 70 nt, Unknown
  Description of Unknown: uncultivated organism
  MG1-8
ggggggaaggcuuaacugacguagaggcccgugacccacugcaucgcacggucacgggccucgguguuuu

SEQ ID NO: 5485 - RNA, 70 nt, Unknown; identical to SEQ ID NO: 5484
  Description of Unknown: uncultivated organism with predicted taxonomy: Verrucomicrobia
  MG1-9

SEQ ID NO: 5486 - RNA, 100 nt, Unknown
  Description of Unknown: uncultivated organism
  MG1-10
acuucaaaaccagcaccccaaguagcguaggagagcgcguucgaucuuggauucaggugugacuccacuacgaaagccccuugauuucucaagggucuuu

SEQ ID NO: 5487 - RNA, 69 nt, Unknown
  Description of Unknown: uncultivated organism
  MG1-11
ggcgauuucaaaaccagcacggauucggcagccccucugcggggcaagcguagguagagcgcgccguuu

SEQ ID NO: 5488 - RNA, 108 nt, Unknown
  Description of Unknown: uncultivated organism
  MG1-12
cgagaucaaaaccugcgguggccaguauuccaaacugucggcuugagagcaggcugguuauuaaccgcaacucuugcacgggggcgagugaaagcuuuagccccuuuu

SEQ ID NO: 5489 - RNA, 106 nt, Unknown; identical to SEQ ID NO: 5480
  Description of Unknown: uncultivated organism
  MG1-14

SEQ ID NO: 5490 - RNA, 101 nt, Unknown
  Description of Unknown: uncultivated organism
  MG2-1 tracrRNA
gccagaucaaaaccugcggaauggucgguucgagagccacccauaagaacccgcaacucgaacacacuuuccggggcgagccagaugcucgccccgcuuuu

SEQ ID NO: 5491 - RNA, 70 nt, Unknown
  Description of Unknown: uncultivated organism
  MG2-7 tracrRNA
uuggaaucaagacaaaguuaauuaaggcaguucggaccucuacuuuguacgucaggauagaaagccuuuu

SEQ ID NO: 5492 - RNA, 118 nt, Unknown
  Description of Unknown: uncultivated organism with predicted taxonomy: Verrucomicrobia
  MG2-5
uuggaaucaagacaaaguuagauaacgcaaacugcgucccuauccgccaagcggauacaccuguucaaaagcguuucuuaaagagccucggcagggaguaaucucggucggggcuuuu

SEQ ID NO: 5493 - RNA, 74 nt, Unknown
  Description of Unknown: uncultivated organism with predicted taxonomy: Verrucomicrobia
  MG2-8
ggaaucaagacaaaguuagauaacgcagaccguuucccuauccgccacgcggauacaucgguucaaaagcguuu

SEQ ID NO: 5494 - RNA, 74 nt, Unknown; identical to SEQ ID NO: 5493
  Description of Unknown: uncultivated organism with predicted taxonomy: Verrucomicrobia
  MG2-10

SEQ ID NO: 5495 - RNA, 82 nt, Unknown
  Description of Unknown: uncultivated organism with predicted taxonomy: Rothia
  MG3-6 tracrRNA
uaacgaaagauucuuaauaaggcauccuuccgaugcugacuucucaccguccguuuuccaauaggagcgggcgguauguuuu

SEQ ID NO: 5496 - RNA, 80 nt, Unknown
  Description of Unknown: uncultivated organism with predicted taxonomy: Rothia
  MG3-7 tracrRNA
aaugaagguucccaauaaggcgcaucuuggcgcugacuucucaccguccucuugcugcuuagcagagggcgguauguuuu

SEQ ID NO: 5497 - RNA, 82 nt, Unknown
  Description of Unknown: uncultivated organism with predicted taxonomy: Rothia
  MG3-8 tracrRNA
uaacgaaagauucuuaauaaggcauccuuccgaugcugacuucucaccguccggcuccucuuaggaacgggcgguauguuuu

SEQ ID NO: 5498 - RNA, 78 nt, Unknown
  Description of Unknown: uncultivated organism with predicted taxonomy: Dermabacter hominis
  MG3-1
ucuugggagagacauugaaauaagcgguuucguaccgugaauucuccagccccucgguuuaccggggggcuucguuuu

SEQ ID NO: 5499 - RNA, 88 nt, Unknown
  Description of Unknown: uncultivated organism with predicted taxonomy: Micrococcales
  MG3-5
ugguuucggaggcgaacgaucccaauaagagacuuaugucuugaauucucagaucccguccgcauugcgcggacgggaucuucguuuu

SEQ ID NO: 5500 - RNA, 81 nt, Unknown
  Description of Unknown: uncultivated organism with predicted taxonomy: Rothia
  MG3-6
agagaagauucccaauaaggcacauuuuuagugcugacuucucaccguccaggguucauugaacaaugggcgguauguuuu

SEQ ID NO: 5501 - RNA, 72 nt, Unknown
  Description of Unknown: uncultivated organism with predicted taxonomy: Rothia
  MG3-7
ugaaagauucucaacauucuacaacuuaucacauagcacauugcaauuauagcaggaguauauguagcuuuu

SEQ ID NO: 5502 - RNA, 82 nt, Unknown; identical to SEQ ID NO: 5497
  Description of Unknown: uncultivated organism with predicted taxonomy: Rothia
  MG3-8

SEQ ID NO: 5503 - RNA, 103 nt, Unknown
  Description of Unknown: uncultivated organism with predicted taxonomy: Planctomycetes
  MG4-5 tracrRNA
aguguauccgagcggcgauugccccuugucacaguaagggacuuucguucgcgaaaggcaaccucgccagcaucgcugggcgaggaccagggcaaggcgauuu

SEQ ID NO: 5504 - RNA, 98 nt, Unknown
  Description of Unknown: uncultivated organism with predicted taxonomy: Arcicella aurantiaca
  MG7-2
uucaacuuuacguaagaacaauuuguaagcaauucacaauaaaagguuuuuaccguugugaaaacauauucuggcgguaacuuuaguuaucgccuuuu

SEQ ID NO: 5505 - RNA, 103 nt, Unknown
  Description of Unknown: uncultivated organism with predicted taxonomy: Collinsella
  MG14-1 tracrRNA
ucaccuuggggaagggcgcggcuccagacaaggggagccacuuaaguggcuuacccguaaaguaacccccguucaaucuucggauugggcggggcgaacuuuu

SEQ ID NO: 5506 - RNA, 100 nt, Unknown
  Description of Unknown: uncultivated organism with predicted taxonomy: Megasphaera
  MG15-1 tracrRNA
auuauaucuuagcgagagauaguagguuauuacaauaagguccaacaggaguguugguaccguaaagcucuaacggcacccacgggugccguuaucuuuu

SEQ ID NO: 5507 - RNA, 87 nt, Unknown
  Description of Unknown: uncultivated organism with predicted taxonomy: Bacteroidales
  MG16-2 tracrRNA
uugugaauugcuuaaauuauguacugcaaaaauaaacaaauauuauuacgaaaaaguuuuuuuaaaaauauuuuuuuacauaacuuu

SEQ ID NO: 5508 - RNA, 83 nt, Unknown
  Description of Unknown: uncultivated organism with predicted taxonomy: Clostridiales
  MG18-1 tracrRNA
uugacuaccauaaggaauuacacuacgaguucaaauacaauuuuuucaaauugcccuauagggcccucacagugugagauuuu

SEQ ID NO: 5509 - RNA, 92 nt, Unknown
  Description of Unknown: uncultivated organism with predicted taxonomy: Firmicutes
  MG21-1 tracrRNA
uuauaccacuacgagagaaaaaguguguuacugcaauaagguaaaacaccacgaagcucugcccuaacugccuuagcaguuagggcaucuuu

SEQ ID NO: 5510 - RNA, 90 nt, Unknown
  Description of Unknown: uncultivated organism with predicted taxonomy: Bacteroidales
  MG22-1 tracrRNA
uugcuaauugaaagcaauucgcaauaaggauuauuccguugugaaaacauuucgaguggcuucgugaaauucacgaagucacuucguuuu

SEQ ID NO: 5511 - RNA, 82 nt, Unknown
  Description of Unknown: uncultivated organism with predicted taxonomy: Clostridia
  MG23-1 tracrRNA
acuuacaaggugagugcaaauaagguuuaaccgaaauuguuuaccugcauugugcaguauaagaaagaccgcgaggucuuuu

SEQ ID NO: 5512 - DNA, 4 bp, Artificial Sequence
  Description of Artificial Sequence: Synthetic oligonucleotide
  MG1-4 single guide 3' PAM
  modified_base (1)..(1): a, c, t, g, unknown or other
nrrr

SEQ ID NO: 5513 - DNA, 6 bp, Artificial Sequence
  Description of Artificial Sequence: Synthetic oligonucleotide
  MG1-5 single guide 3' PAM
  modified_base (1)..(4): a, c, t, g, unknown or other
nnnnyy

SEQ ID NO: 5514 - DNA, 6 bp, Artificial Sequence
  Description of Artificial Sequence: Synthetic oligonucleotide
  MG1-6 single guide 3' PAM
  modified_base (1)..(2): a, c, t, g, unknown or other
nnrray

SEQ ID NO: 5515 - DNA, 7 bp, Artificial Sequence
  Description of Artificial Sequence: Synthetic oligonucleotide
  MG1-7 single guide 3' PAM
  modified_base (1)..(1): a, c, t, g, unknown or other
nrrraag

SEQ ID NO: 5516 - DNA, 6 bp, Artificial Sequence
  Description of Artificial Sequence: Synthetic oligonucleotide
  MG2-7 single guide 3' PAM
  modified_base (1)..(3): a, c, t, g, unknown or other
nnnrta

SEQ ID NO: 5517 - DNA, 7 bp, Artificial Sequence
  Description of Artificial Sequence: Synthetic oligonucleotide
  MG3-6 single guide 3' PAM
  modified_base (1)..(2): a, c, t, g, unknown or other
  modified_base (6)..(6): a, c, t, g, unknown or other
nnrggnt

SEQ ID NO: 5518 - DNA, 7 bp, Artificial Sequence
  Description of Artificial Sequence: Synthetic oligonucleotide
  MG3-7 single guide 3' PAM
  modified_base (1)..(2): a, c, t, g, unknown or other
  modified_base (4)..(4): a, c, t, g, unknown or other
nnrnyay

SEQ ID NO: 5519 - DNA, 5 bp, Artificial Sequence
  Description of Artificial Sequence: Synthetic oligonucleotide
  MG4-5 single guide 3' PAM
  modified_base (1)..(2): a, c, t, g, unknown or other
nnccr

SEQ ID NO: 5520 - DNA, 8 bp, Artificial Sequence
  Description of Artificial Sequence: Synthetic oligonucleotide
  MG14-1 single guide 3' PAM
  modified_base (1)..(4): a, c, t, g, unknown or other
nnnngrta

SEQ ID NO: 5521 - DNA, 5 bp, Artificial Sequence
  Description of Artificial Sequence: Synthetic oligonucleotide
  MG15-1 single guide 3' PAM
  modified_base (1)..(4): a, c, t, g, unknown or other
nnnnc

SEQ ID NO: 5522 - DNA, 6 bp, Artificial Sequence
  Description of Artificial Sequence: Synthetic oligonucleotide
  MG16-2 single guide 3' PAM
  modified_base (1)..(1): a, c, t, g, unknown or other
  modified_base (4)..(4): a, c, t, g, unknown or other
nrtncc

SEQ ID NO: 5523 - DNA, 6 bp, Artificial Sequence
  Description of Artificial Sequence: Synthetic oligonucleotide
  MG18-1 single guide 3' PAM
  modified_base (1)..(2): a, c, t, g, unknown or other
nntart

SEQ ID NO: 5524 - DNA, 5 bp, Artificial Sequence
  Description of Artificial Sequence: Synthetic oligonucleotide
  MG21-1 single guide 3' PAM
  modified_base (1)..(2): a, c, t, g, unknown or other
  modified_base (4)..(4): a, c, t, g, unknown or other
nnrnr

SEQ ID NO: 5525 - DNA, 6 bp, Artificial Sequence
  Description of Artificial Sequence: Synthetic oligonucleotide
  MG22-1 single guide 3' PAM
  modified_base (1)..(2): a, c, t, g, unknown or other
  modified_base (5)..(5): a, c, t, g, unknown or other
nnrcnt

SEQ ID NO: 5526 - DNA, 4 bp, Artificial Sequence
  Description of Artificial Sequence: Synthetic oligonucleotide
  MG23-1 single guide 3' PAM
  modified_base (1)..(1): a, c, t, g, unknown or other
nrra

SEQ ID NO: 5527 - DNA, 6 bp, Artificial Sequence
  Description of Artificial Sequence: Synthetic oligonucleotide
  MG1-4 dual guide 3' PAM
  modified_base (1)..(1): a, c, t, g, unknown or other
nrrraa

SEQ ID NO: 5528 - DNA, 6 bp, Artificial Sequence
  Description of Artificial Sequence: Synthetic oligonucleotide
  MG1-5 dual guide 3' PAM
  modified_base (1)..(1): a, c, t, g, unknown or other
  modified_base (3)..(4): a, c, t, g, unknown or other
nrnncc

SEQ ID NO: 5529 - DNA, 6 bp, Artificial Sequence
  Description of Artificial Sequence: Synthetic oligonucleotide
  MG1-6 dual guide 3' PAM
  modified_base (1)..(2): a, c, t, g, unknown or other
nnrrwc

SEQ ID NO: 5530 - DNA, 6 bp, Artificial Sequence
  Description of Artificial Sequence: Synthetic oligonucleotide
  MG1-7 dual guide 3' PAM
  modified_base (1)..(2): a, c, t, g, unknown or other
nnrraa

SEQ ID NO: 5531 - DNA, 6 bp, Artificial Sequence
  Description of Artificial Sequence: Synthetic oligonucleotide
  MG2-1 dual guide 3' PAM
  modified_base (1)..(1): a, c, t, g, unknown or other
nrcgta

SEQ ID NO: 5532 - DNA, 7 bp, Artificial Sequence
  Description of Artificial Sequence: Synthetic oligonucleotide
  MG3-6 dual guide 3' PAM
  modified_base (1)..(2): a, c, t, g, unknown or other
nnrggtt

SEQ ID NO: 5533 - DNA, 7 bp, Artificial Sequence
  Description of Artificial Sequence: Synthetic oligonucleotide
  MG3-7 dual guide 3' PAM
  modified_base (1)..(2): a, c, t, g, unknown or other
  modified_base (4)..(4): a, c, t, g, unknown or other
nnrnyay

SEQ ID NO: 5534 - DNA, 7 bp, Artificial Sequence
  Description of Artificial Sequence: Synthetic oligonucleotide
  MG3-8 dual guide 3' PAM
  modified_base (1)..(2): a, c, t, g, unknown or other
nnrggtt

SEQ ID NO: 5535 - DNA, 8 bp, Artificial Sequence
  Description of Artificial Sequence: Synthetic oligonucleotide
  MG14-1 dual guide 3' PAM
  modified_base (1)..(4): a, c, t, g, unknown or other
nnnnggta

SEQ ID NO: 5536 - DNA, 8 bp, Artificial Sequence
  Description of Artificial Sequence: Synthetic oligonucleotide
  MG15-1 dual guide 3' PAM
  modified_base (1)..(4): a, c, t, g, unknown or other
nnnnctaa

SEQ ID NO: 5537 - DNA, 6 bp, Artificial Sequence
  Description of Artificial Sequence: Synthetic oligonucleotide
  MG18-1 dual guide 3' PAM
  modified_base (1)..(1): a, c, t, g, unknown or other
nrwart

SEQ ID NO: 5538 - RNA, 72 nt, Unknown
  Description of Unknown: uncultivated organism
  MG2-4 putative tracrRNA
uuugaaucaagaucaaaguaaacggccccgcuccggacccugccuggcacuccggaugcgcuaggguuuuuu

SEQ ID NO: 5539 - RNA, 110 nt, Artificial Sequence
  Description of Artificial Sequence: Synthetic polynucleotide
  MG3-8 putative sgRNA
  modified_base (1)..(22): a, c, u, g, unknown or other
nnnnnnnnnnnnnnnnnnnnnnguugagaaucgaaagauucuuaauaaggcauccuuccgaugcugacuucucaccguccggcuccucuuaggaacgggcgguauguuuu

SEQ ID NO: 5540 - RNA, 143 nt, Artificial Sequence
  Description of Artificial Sequence: Synthetic polynucleotide
  MG16-2 putative sgRNA
  modified_base (1)..(22): a, c, u, g, unknown or other
nnnnnnnnnnnnnnnnnnnnnnguugugaauugaaaaauucacaauaaggauuauuccguugugaaaacauuuaaagcggggucaacagccucgcuuucuuuuugagucuaugagacauuaggucaauaagucuaugaguuuu

SEQ ID NO: 5541 - DNA, 122 bp, Artificial Sequence
  Description of Artificial Sequence: Synthetic polynucleotide
  MG16-2 putative sgRNA
  modified_base (1)..(22): a, c, t, g, unknown or other
nnnnnnnnnnnnnnnnnnnnnngttgtgaattgctttaaattgaaaaatttaagcaattcacaataaggattattccgttgtgaaaacatttaaagcggggtcaacagcctcgctttctttt

SEQ ID NO: 5542 - DNA, 103 bp, Artificial Sequence
  Description of Artificial Sequence: Synthetic polynucleotide
  MG16-2 putative sgRNA
  modified_base (1)..(22): a, c, t, g, unknown or other
nnnnnnnnnnnnnnnnnnnnnngttgtgaattgaaaaattcacaataaggattattccgttgtgaaaacatttaaagcggggtcaacagcctcgctttctttt

SEQ ID NO: 5543 - RNA, 22 nt, Artificial Sequence
  Description of Artificial Sequence: Synthetic oligonucleotide
  MG1-4 guide sequence 1 for targeting VEGFA
aauauguagcuguuugggaggu

SEQ ID NO: 5544 - RNA, 22 nt, Artificial Sequence
  Description of Artificial Sequence: Synthetic oligonucleotide
  MG1-4 guide sequence 2 for targeting VEGFA
cuagggggcgcucggccaccac

SEQ ID NO: 5545 - RNA, 22 nt, Artificial Sequence
  Description of Artificial Sequence: Synthetic oligonucleotide
  MG1-4 guide sequence 3 for targeting VEGFA
uggcuaaagagggaaugggcuu

SEQ ID NO: 5546 - RNA, 22 nt, Artificial Sequence
  Description of Artificial Sequence: Synthetic oligonucleotide
  MG1-4 guide sequence 4 for targeting VEGFA
cacaccccggcucuggcuaaag

SEQ ID NO: 5547 - RNA, 22 nt, Artificial Sequence
  Description of Artificial Sequence: Synthetic oligonucleotide
  MG1-4 guide sequence 5 for targeting VEGFA
ucggaggagccgugguccgcgc

SEQ ID NO: 5548 - RNA, 22 nt, Artificial Sequence
  Description of Artificial Sequence: Synthetic oligonucleotide
  MG1-4 guide sequence 6 for targeting VEGFA
gcggaccacggcuccuccgaag

SEQ ID NO: 5549 - RNA, 22 nt, Artificial Sequence
  Description of Artificial Sequence: Synthetic oligonucleotide
  MG1-4 guide sequence 7 for targeting EMX1
guacaaacggcagaagcuggag

SEQ ID NO: 5550 - RNA, 23 nt, Artificial Sequence
  Description of Artificial Sequence: Synthetic oligonucleotide
  MG1-4 guide sequence 8 for targeting EMX1
gaggaagggccugaguccgagca

SEQ ID NO: 5551 - RNA, 22 nt, Artificial Sequence
  Description of Artificial Sequence: Synthetic oligonucleotide
  MG1-4 guide sequence 9 for targeting Apolipoprotein
aaggcaaacauccugauaaugg

SEQ ID NO: 5552 - RNA, 22 nt, Artificial Sequence
  Description of Artificial Sequence: Synthetic oligonucleotide
  MG1-6 guide sequence 1 for targeting VEGFA
ucuuuagccagagccggggugu

SEQ ID NO: 5553 - RNA, 22 nt, Artificial Sequence
  Description of Artificial Sequence: Synthetic oligonucleotide
  MG1-6 guide sequence 2 for targeting VEGFA
uggacccccuauuucugaccuc

SEQ ID NO: 5554 - RNA, 22 nt, Artificial Sequence
  Description of Artificial Sequence: Synthetic oligonucleotide
  MG1-6 guide sequence 3 for targeting EMX1
augggagcccuucuucuucugc

SEQ ID NO: 5555 - RNA, 22 nt, Artificial Sequence
  Description of Artificial Sequence: Synthetic oligonucleotide
  MG1-6 guide sequence 4 for targeting EMX1
ugccacgaagcaggccaauggg

SEQ ID NO: 5556 - RNA, 22 nt, Artificial Sequence
  Description of Artificial Sequence: Synthetic oligonucleotide
  MG1-6 guide sequence 5 for targeting HBB-R01
uggugucuguuugagguugcua

SEQ ID NO: 5557 - RNA, 22 nt, Artificial Sequence
  Description of Artificial Sequence: Synthetic oligonucleotide
  MG1-6 guide sequence 6 for targeting HBB-R01
gggcagguugguaucaagguua

SEQ ID NO: 5558 - RNA, 22 nt, Artificial Sequence
  Description of Artificial Sequence: Synthetic oligonucleotide
  MG1-6 guide sequence 7 for targeting FANCF
aggugcugacguagguagugcu

SEQ ID NO: 5559 - RNA, 22 nt, Artificial Sequence
  Description of Artificial Sequence: Synthetic oligonucleotide
  MG1-6 guide sequence 8 for targeting FANCF
gcccuacuuccgcuuucaccuu

SEQ ID NO: 5560 - RNA, 22 nt, Artificial Sequence
  Description of Artificial Sequence: Synthetic oligonucleotide
  MG1-6 guide sequence 9 for targeting IVS40
aauguaugcuggcuuuuaaggg

SEQ ID NO: 5561 - RNA, 22 nt, Artificial Sequence
  Description of Artificial Sequence: Synthetic oligonucleotide
  MG1-6 guide sequence 10 for targeting IVS40
gcuccuuuggcuagggaagugu

SEQ ID NO: 5562 - RNA, 22 nt, Artificial Sequence
  Description of Artificial Sequence: Synthetic oligonucleotide
  MG3-7 guide sequence 1 for targeting VEGFA
ccccuauuucugaccucccaaa

SEQ ID NO: 5563 - RNA, 22 nt, Artificial Sequence
  Description of Artificial Sequence: Synthetic oligonucleotide
  MG3-7 guide sequence 2 for targeting EMX1
ugugguuccagaaccggaggac

SEQ ID NO: 5564 - RNA, 22 nt, Artificial Sequence
  Description of Artificial Sequence: Synthetic oligonucleotide
  MG3-7 guide sequence 3 for targeting HBB-R01
ggcccugggcagguugguauca

SEQ ID NO: 5565 - RNA, 22 nt, Artificial Sequence
  Description of Artificial Sequence: Synthetic oligonucleotide
  MG3-7 guide sequence 4 for targeting HBB-R01
uccuuaaaccugucuuguaacc

SEQ ID NO: 5566 - RNA, 22 nt, Artificial Sequence
  Description of Artificial Sequence: Synthetic oligonucleotide
  MG3-7 guide sequence 5 for targeting HBB-R01
cugacuccugaggagaagucug

SEQ ID NO: 5567 - RNA, 22 nt, Artificial Sequence
  Description of Artificial Sequence: Synthetic oligonucleotide
  MG3-7 guide sequence 6 for targeting FANCF
uccgagcuucuggcggucucaa

SEQ ID NO: 5568 - RNA, 22 nt, Artificial Sequence
  Description of Artificial Sequence: Synthetic oligonucleotide
  MG3-7 guide sequence 7 for targeting FANCF
uaucauuucgcggauguuccaa

SEQ ID NO: 5569 - RNA, 22 nt, Artificial Sequence
  Description of Artificial Sequence: Synthetic oligonucleotide
  MG3-7 guide sequence 8 for targeting Apolipoprotein
ucgggcagagggugcaucaccu

SEQ ID NO: 5570 - RNA, 22 nt, Artificial Sequence
  Description of Artificial Sequence: Synthetic oligonucleotide
  MG3-7 guide sequence 9 for targeting Fibrinogen
auaauaagcagaacuuuuagug

SEQ ID NO: 5571 - RNA, 22 nt, Artificial Sequence
  Description of Artificial Sequence: Synthetic oligonucleotide
  MG3-7 guide sequence 10 for targeting Fibrinogen
guuuucuuuaguuauuaauuuc

SEQ ID NO: 5572 - DNA, 3075 bp, Artificial Sequence
  Description of Artificial Sequence: Synthetic polynucleotide
  MG1-4 sequence codon optimized for E. coli
atgaaaaagaaagttttcgcatttgatcttggtaaagcaagtattggttactgcgtccgtgacggatttaatatcaatgaagctaatagtattatcatcgataaagatcatgccgagaccatgtctctgcgtgaccgtcgccggattaaaaaaacactcgacgcccatcatgcacgtgaggaatacttcaacaaagtttggtcgggcgtaggcctcaacatcttagataaaaataacaacaacttcaaaaaagagtttccctctaaaaacgaggacgtaatctacacctcctgcttgctgcgcatcgcgctgctccagaatcaaaaattagaggagtggcagatttataaggcgctgtataatgctttccagcgtcgtggttacgatgttaatatcgcatggaagagcgttcaaacagacgacgacaaggaaaacatcgaacgcatgaaaaaatatacatgcgaaaacgatatcgaactgattatcagcgatgagtacaaatatccctgttactatgatgctttgcgtttgggcctgtggaacgaagatgaacccacgaaattgaaccgttcaattccacaacacaatagcaataaggtccgcactactgaatatgtcgcgccgcgcgaactcgtagaaaaggaactcaagcagctgtggttaaacgcgcagctgcaactgccccagttaaacagtatttcagccgaggaattcttatacggcgaatacaaaattccatatggtagctgcgtacaaaaggaattcaaacagtatcgtggcacaaaaaaagactggcaaggtgttctgtgtcagaagattccgcgcttcgataaccgcattattgctaagtgcaaactgctgccgaaacgcaacgtatgtaaagctaacactattgagaacgtaagtttcgtcctgctgatgaaacttaagaatcttcgcttcaccgtaatttccggtgaaaaattgcgtttgtcgccggtccagattaaacaaatttatgaaaactggcttgaaaaagtagaagatacgtataataaggacctggaaaaggccgaaaaattaggtaaagagaacccggaaaaacgcttgaatatcactattacccgccaggaaatcgagaaaatcattggggaaaaaattattgataagatcgaacccatgaaagcagatattagtggtcgctcgagtttttgtcgtcgtgcctgccaaatcatgaacaaaattatcctggacggcgaactctatccgcagaacgtggacattagtgagttcgtggaccgcgataacgcaaaaaatggcatcacggaagaggaaatccagtcaatgttatccaagattggtgactggaataacctgtatattccggataatcgcgaggaaaatgctcagaacgctagcaattcgcgtattaaaactgacattatgttaggcaacattaccaatccgattgtacgtaaccgcttgcagatctttcgtgatcttttgctgaacttggcggaaaaatacgggaccccggacgaagtcatttttgagttcgtgcgcgatggcgcagataactccctgtacggcagcaagaaggcacaggataccgaacgctttatgaaacagcaagagaaggaaaacgaacaaatcattaatgaactgaaagatgcgggcttatatgtcaacggtcaaaatcatgcaaatgccacgtacttcctgatgcacaaactcctgaaaagtcagggtggcaagtgtatctacagtggccaaaacatcagcccgtctaactatgacgaatgcgagattgatcatatttatcctcgtacgctgggaggcaacgacgctctctacaacaaagtggtttgttatcgtcgtgaaaaccaggacaaaaaaggccgcaccccgtatgaatggctgagtccggacagcgataaatgggctaattacgtcaatcgccttaacaagatcaagaaacagctggggaagaaaaaattcgaactgctgacctctaagccagaagattgtgaaaaactgatcgaaagttataacggtctcgcggagactagtcatattgcacgcgtagctcaacagatgactgctttcatctttggctggggtctgcagatccagggtgagagccggcgtattttcgtgaataacggctcttcgacctgtgccatccgcaaacgctatgggttaaacaaattactgggcgataacctgaaaaaaaatcgctctaacgataaacaccacgcccttgacgctatttgcatcagtttttctcgtgattttaaatatgacaaagaaattaaaaaagacatcattaagggtttcaatccggaaattgtcaagaacgcgatcgataaaatcatgccttatccctatgcaaatgataagccgtttaaaggtaacaccaaacccctggaaactatctacggtcttcgtacgtacggcgacaaaagttatattactcagcgcgttgaactgaactcgattgataaaaaagcgactaaaattaaatcgattatcgatgaaaccatcaagaatgacttgctgaataaactgaaggaaaacccgacagagcaggagtggaaactgatgctgcaaaattatattcatcctaaaaaacagactaaagtgaaaaaggtgatgatttctgtgtcagagggagagattactaaagatagcaacaatcgcgagcgcatgggcgaatttgttgactttggcacgaagggcactcagcatcagtttaaacattctaaacgccataagggccaaatcctgtattttaatgaaaaaggcgtcgtggaggtaatgccggtttattcgaatatcaaaaccacggacgtgaaagataaacttcagaatatggggtgtaaactgtataacaagggccagatgttctacagcggttgtctggttgatatcccaaaaccattcaaagcgggctcgaaggagtatcctgctggccgctaccaaatcaaaacgattcgcagtgataaagtggccgaactggaagacgcctgcggtaacaagatcagtacgaatgtgaaatacctggtacctgccgaatttaaaaaagtcgaaagcaaa

SEQ ID NO: 5573 - DNA, 3231 bp, Artificial Sequence
  Description of Artificial Sequence: Synthetic polynucleotide
  MG1-5 sequence codon optimized for E. coli
atgcacactaaagagacggtttggggatttgatattggtaagggatctttaggtgaggcggtccgcgtcggcaacgaatttaagcacgtacttagcatggagatcgatgctgacttcgcagagatcaagacggccgcggctacacgccgcgcatggcgtacgcgtgaggcccacaaggcccgtgagatgtggcttgaaaagtgcctgagtgacgcggacattgagatcttaggccgtcgtaaagtggatatcgtggacggcacctggaagctggtttcccgtggtgacggccgtttagagcgcgagtttccggcggatggcgagaatgtatgctacaattctattgcgttgcgttgtaagcttctcctgggtgagaagctggagtcctggcaggtctttaaagctttaaattcagcaattcagaatcgcggatacgacgcgcaaatcccatggggcgacgaagacggaaagtcgtccgaaacaaagcgttccggcaagtccgattccgccaagaagtcgggcgaggatgaaagttatgcagagcgtctggcattgtttgaacgtgagttcgacaagctgttggcggaagtagaaaatcgtgagaagtatgacttcccgtgtttcttcaaggcagcgaagatgggactttggtcaccagagaaccctgacaaggtcggcatccgtattgataataccgcggagaaggcaaagggatatgtggtgccccgcaatgcggttatcgcggagtttcgcgcgcttgttaatgctgccgcaaaacaatacccgaagttgaagggaaaggccgattttatcatgttcggaaaggccgaagaagcatacgcctcgtacaagcctgaattacgtcgcaagtttggcctgcgccgcggcgctgattcagactggactgctctcggtcagaaaacaccccgcttcgacaaccgcattatcgggaagtgtaagcttatcccgcgtctgaatgtctgcaagatcaaacctctgaaggagtgtaaggccgaggatgatttcttaccgcatacgatcacgctggccttgaagctgcttaatcttcgcttcttccgtggcgccggcatcgactcgttatcgttcgacgagtttcttcgcgcctttgaaattgcccgccaaaataagtttgccctgaacaagacgaatctcaagaagttcttcaagactatcggagcggagattatggacgagaatcaatccagtgtggaacagccccgcgagggtgggcgtgccagctacagtcgtccagcgatgcgccttctccgcgatctgatcttcagtgggaagtccccggctgagttctacgcatcccgtatttgcaagattgagaataccgataagaatcgcggactggttgcggaagacttggcgttcattaaattgatgggtgatattccctggaacggtatctttgttccagacgttgacacattcaattttgcgaatattcgcgagtccgagcgtgcagataagatcaacaagctgattggcagccaaaatgacccaatcgtgcgccaccgtctggcattcttctatgagcgcattaagctgcttgaatctaaattcggagcacccgacaagatcgtgttagagtttgttcgtgacgacttcttagggtctaaggcaaagaaagagatgtcgcagggtatcaagaagcgtttcgaggaaaagaagaaacttgcagaggagttagacagtcagcgtgccgagtttggtaacaaatacgcgtccaagaagatgcttttaaagtttgagctgtataagaagcaacgcggacgttgcgtgtacacggacaatgcgttgccgctgtctgaacttgagaacttagaggttgaacacattttcccgcgcagccgcggcggcgccgacgcaatgtacaactatgtccttactgacgagaacactaacaagcagaaaggggacaagaccccgtttgagtggttaagcagcgacaagacaaaatgggaatcttactgtgatcgcgtgcgtagtttaacccagagcctgggcgccaaacgctgcaagttgcttgtaagtccaaatgcagaagagctcatgcagaaatacacagcgctcgccgagactgcctggatctccaagctggcgcaaaagatttgctgtatccacttcggctttcagtttggcggcttaaagggtgagaagaaggtctggactgtgagcggaaataccacggccatgattcgtggccgttacggtttaaaccgccttctgcataatgaagagatcagtgaggacctgccgctgttagatcgcatcgtaaaggaaaagaacttcgaggaaaagaatcgtgataataagaagcaccacgcgttagacgctatgtgtatctgtttcgcgcctacgagcaatgcgaagaaagcgctctcacgtaagaacatcttgcccgaggaaattgcaaagaaccccgaatccgacgacgcccgtaatttcttcgcgaagtatctggccgaggttgttcccactaaggtggcgattaagaagccggagctggagcaaacaatctactccaagcgtgtaatcggtggccgtcaaactattgtgaagaagtgtaacgtgcgcgatcttgcttacaagggtcaaaacccaaagtacgacttcgacacgcttacgaagcgcatcaaggatatcatcaatccggttagcaagcgcgtcattgaagattttgcgaagaccgaaccaaccgaggcggagtgggaagattggtgtaagtacgaagcggcaatcccaagtaagaatggttctccgacgcgcttgcttcgtgtattatgcaagacgaaggacgatgccgagcgttttaaggatttgtcaaaggatggctgcggtgcgtatcgtaagtccaagtcgcacaaaggccagtttatctggaaggataacaagggcaattatctcgttgctccggtttacatttacagcagcaagcagaaggtgtatgcggaactcaagaataaccctaagtgtatgggcatttgcgatttcttcaagacgggctgcctggtgaagatcagcaacgaggtggttgacgagaagaagaatcgtctctggttaaaggcgggcttttacaacctcaacagcatcgccaaggagaagcgtgtgtatcttaccgatgtaaacggccaggagcacaagaagattccgctgcaacatttgatgaacgcaggaatgaagcgtgtcgagacgaatacaatc

SEQ ID NO: 5574 - DNA, 3177 bp, Artificial Sequence
  Description of Artificial Sequence: Synthetic polynucleotide
  MG1-6 sequence codon optimized for E. coli
atggagaaagaaaagaacaaccatgtttggggctttgatattggcaaagggtctctgggtgaagcagttcgggttggtggcgattttaagcatattgcctcagttctgcttgacccggaatttggggaaatcaaaactgcggccctggctcgccgtcagatgcgcacacggaaagcccataaagctcgcgagaaatggctcgaggagtgtctcgacggcaccggtgtggagattctcaaacgccgcgaagtgggaattgttgatgggcagtggcgccttatctcgaaaggtgatgaacgcctggaacgcgaatttccgccgaacggcgaggaagtgtgctacaactctattgccctgcgttgtaaattattgctgggcgagaaattggaagggtggcaggtctttaaagccctgaacagcgctattcagaaacgcggatacgatgagaatatcccttggggggaagccgaggaaaagtccagcaaaaaggacgaagatgattacgcgcagaaattaagccaatacgagcgtgaaaaatctgaactgtttgaaagttttgctgatggggaaaaatacgactttccttgctttttcaaagcatataaaatgggtctgtggagtccggaaaacccgcgtcgcgtcgaggtccgcattgattgtcgtgcgcaaaaagcaaaatcgtacgtggttgcacgcaaatatgtagaacgcgaatttgaatgtctggtggaagcggccgcgaaattttttccgaaactgaaaggccgcgcgaaattcatcctgtacggcgtctctgagaccccgtacgcatcttactatggtaacatgcgcaagaaatttggcctgaaacgcggagcggagagcgattggaccgctcttggccaaaaagtcccgcgttttgataaccgtattatcgataaatgtcgcttaatccctcgcatgaatgtctgtaaaatccgcccactgaacgaagctcgcaacgaaaaggacctgctgtattatgaggtgaccctggcattgaaacttcttaacttgcgtttctttcgcaactcgaacatcgaacagctgaccttcgaggaatttaaaaaggcctttgaaatcgcgtctggcgccaaatacaaaatgactaaaacggcaatgaaaaaatttctcaaatctatcagcgccaccgcgttaggtgacgattatgcagaaatcgaaccgcctaaggagtctgggcgtgcttcgttttctcgtccagccatggatattttgaaagaactgatttttagcggaatgccgccgcgtgagttttacggccgcaaaatccctgagatctcgaacacggacaagaacaaaggggttgttgcctctgatctggactttatcaaacttatgggcgactgcccatggggcgggatttttatcccagacgtacagacctatcagtttgcgaatgcggcgttcccgaaccctgatgcacagatcaataaactgattggtagtcagaacaaccctatcgttcggcaccgtctgaccttctttttcgaacgcatcaaatttcttgaaagcaaatatggcgtgccagataaagttgtgctggagttcgtgcgtgacgattttatgggagaaaaagaaaaaaaagaaatgcgtatcgctatgaaaaaacgcgctgaagaaaaaatgatgatcgccaaggacctcgacgagcacggtttcaaaggcggcaatctgctgcttaaaatggaattgtatcgcaaacagaatggcatttgcttgtacaccggcgacgcgctgcccctttcagagctcgcgactcttgaaattgagcatattgtgccgcgttcccgcggcggtccggatgcacaatacaactatgtaattacccgtgaaaaaaccaataaattgaaaggggataaaaccccatatgaatggctgtcctcggacgccaaggagtgggcctcatataccgatcgtgtgaacgcgtgcgcgaaagctctgggcaaaaaacgttgtcgtctgttgctggagaaagacgcagaggaattagtcgagaaatacaccgcgctggcggaaacggcccatatcgctaaactggcccaaaaaatcgtctgcatgcatttcggtttccaatttggcggtttgtccggcacgaagcgcgtatttacggtccctggggccctgaccagccggattcgcaaattctacggtctcgatcgcattctgcacaacgcggcagcggaaagtgaaaatctcagctttgaagaattcttgaaatttagtgaagatctggagaagaaaaaccgcaaaaataaaaaacaccacgccctggatgcgatgtgtctgtgttttgctccaaccggggtggacagccggcgcgcgaaactgggggaaattttaccggaaaagctgcgtagtgaaaaagcagcccgcgagttcttcaagtcttaccttgataaaatcatgccggtcgatgtggctcccaaaaaaccccgtttggaggacggcatctatagtaaacgcattattgggggtaaagcctgcatggtgaagcgtaacaacttggttgatctggcttataaaagcggcctgaaaccggtgttcgacatcccgacgctgatcaaattagttgacaaaaaggaaaagggcattattaatccgcagattcgtaaaatgattggcgaatttgctgccaccaatccggacgaatcagcgtggcgtaaatggtgcgaagaggtacgtcttccgagcaaatctggcctgggtgcccgcgttttacgcgtcctggtgtactacggcgaagccgatgaatataaggatctgagtaaggatggctgtggtgcttatcggaaaggcgacggccataaaggccaggtggtgtgggaaagtgtggatggaaaatattacgttgaaccggtctatgtacacgcttcgaaagcgggagttatggcggccttgaatgcgaacccgaagaaaaaacgcatctgcggtatgtttaattcccattgcaccgttgatgtcggcgatgtgtacaacgatcgcggcgattttattcttccagccggccgctacatggtcaataccatcctgacgaccgggcggtgtgtcttgaccaacgccgacggtgaaaaacgcaacccgatcaacattaactacctgatgcgcgctggtatgcgccgcgtcgagttaagtgaactg

SEQ ID NO: 5575 - DNA, 3183 bp, Artificial Sequence
  Description of Artificial Sequence: Synthetic polynucleotide
  MG1-7 sequence codon optimized for E. coli
atgaaggtgatggaagacgagggtggcaatcacatctggggctttgacatcgggaaaggttcgctgggcgaagcggtgctggacggctcagaattcaaacacgtggcgagcctgctcctggacgctgactttggagaaattgagacagccgccggattacgccgtcaaatgcgcacacgcaaagcacacaaggctcgtgagaagtggcttgagtcctgtctgagcggttttggtattgaaacattgaagcgtcgtgaggtcggcatcgttaatggccagtggaccctcatttcgaaaggggatgagcgcctggaacgtgagtttccaccagatggtgagaacatttgttacaacagtattgctctccgctgcaagttgttactgggcgaaaagctggaagggtggcaaatctttaaagcactcaacagcgcgatccagaatcgtggctatgatgagaacatcccgtggaaggaaagcgatgctagtccgtcgaagaaagaaggcggggactatgcgcagaaactgtcacaatactctcgtgaaaagtccgagcttttcgaatctttcgagggtggtgagaagtatgattacccctgtttctttaaagcgtataaaatgggcctgtggagccctgacaacccagaacgtgttgaagtccgtattggatccgatgcacagaaagcaaaagattacgttatcccgcgtaaggatgttgagcgcgaattcgagcgcctggtggaagccgcctcgaagtggtaccctgccatgaagggcaaagcgatgtacatcatgtatggtatcgccgagaccccatatgctagctacaagcccctgctgcgtaagaaattcgatttgaagcgtggggcagagtctgattggaccgctctgggtcagaagattccacgcttcgataaccgcatcattgataagtgtcgtcttatccctcgtcttaatgtgtgtaaaattcgcccactgtccaagattcgcggggaagccgacctgttacactatgaaatcacattatcgctgaagctcctgaacctgcgtttctttcgcaactcgaacgtggagtcactgagcttcggagagtttaaagcagcattcgagattgccaagggagccaagtataaaatgggaaaagccgccttaaagaaattcctgaagagcatctccgccagtgtcttatctgaagatcaatctgagattgaggcgccacgtgaatcgggtcgtgcagccttcagccgtccggcgatgctgctgctgaaggaactgattttctctggtatgaccccagcggaattctatgcaaagaaaagcggagagatcagcaacgcggaccctaataaaggaatcgtagcctcagacttagacttcatcaaactcatgggtaactgtggctggagtggcatcttcatccctgatgtagatacatttcacttcgccaataagggagcagaaccagcgaagttgatcaatgaactgattggcagccaaaataacccaattgttcgtcatcgcctgagcttcttttatgaacgtattaaattcctggagagtaagtttggcatcccggataaagtagtattagaattcgttcgtgaggattttatgggtaaggaacagaagaagcgtatgcagattgagatgaagaaacgtgcttctgaaaagatgttgatcgccaagaaattagatgaagccggctataaaggtgggaaccttcttctcaagatggaactgttggagaagcaaggcggtgtctgtttgtacacgggtgaaccgcttttgccttccgaactcggtgtgctggagattgaacacattgtaccacgttctcgcggcgggcctgatgctcagtataattacgtccttacacgtgaaaagacgaataaagagaaagcagatcgcactccattcgagtggctgtcttcagacccggtcaagtgggctggttacagcgatcgtgtgaaagcccgtgctggtcaactggggcgcaaacgttgtgagctgttgttagagaagaatgcggaagagttggtagagaagtacactgccttagctgaaactgcccacatctcgaagctggctcagaagattgtgtgtcttcactttgggtttcagtttggcggcctgagtggcacaaaacgtgtctttacggtccctggagcattaactgcacgcatccgtacgttttatggcctgaacaagatcttacataatgaagacttggcccacgaaacactgagcttcgagggcttcctgaaacgtggtgaagagttagataagaagaatcgcgcaaacaagaagcatcacgccttggatgctatgtgtttgtgcttcgctcctacaggggtaaatagcaaacgtgcccgtgtggacatgctcctgccaccaaagatccgtagcgagaaagaagcggaacttttctttcgtaaatacttagataaactcatcccagtggatgtcgcaccaaagaaacccaagctggaagatggtatttactccatgcgtacagttggtgggaagaaaatcatggcccgccgtgtaaacctggttgacctggcatacaagagcggcctgaagccggtgtacgacgtatcggtcctgatcaaacttcttgataagaaagagcgcggcatcattaatcctcagatccgtaaactggtagcagactttgcccgtaccaacccaagcgaagatgagtggaagaaatggtgtggtgagtgccgtttacctagcaagaatggtctgggcacccgtgtaattcgcgtgctgctgaactatggtgagccggcggagtataaagacctgagcaaggatggccgtggtgcatttcgccgcggtgatggtcacaagggccaaattgtgtgggagtccaccgatggcaagtactgtgttctcccaatctatgtgcatgcaagcaaggccaaattattagcagaactctgtgcaaacccgaagaagaagcgcatttgtggtattttcaccagtcattgcatggtcaaggtgggtaacacctacaacaataaaggtgagttactgctgccggaaggagtttacatgcttaacaccattcgtacggatggatggatccagctgacgtctgccaatggtgacaagtcaaaaccaattaatattaactacctcatgaaggcgggtatgaagaaggtccctgtgaaggattta

SEQ ID NO: 5576 - DNA, 3999 bp, Artificial Sequence
  Description of Artificial Sequence: Synthetic polynucleotide
  MG2-1 sequence codon optimized for E. coli
atgccaaccaccaacccctatgtaatcacacacgtgacgaagaattggatgaaggatgagttttacgattcagctcttgtcctcggtttggatattggaattgaaggcatcggcgtttggttgcggaaaggccgcgaaccgctttttgcccgtacattcatggtttcgctcccggaagcggctccgctgaagaatcggcgcgccaaacgagcacaacgacacgcccggcagagcctccgtcgtcgtgaggccatgttgcgcgagtgggttgttcgctacggcttgcttccccaggaaaaaactgacggacggtggtggaagaaccctgccgtttttgagcgggccttcgagcatcgtcatcgagcgattaccaccggggtagccagtcctgaatgtttagtcgtatgcatccgtcacctcttgcggcatcgcggttttgattatcacctgaccgacgagggggctttcccgtggggtgatgaattggatgataaggaaatcatccagtgggccaagaactcgtgttgcgcaccggagtatcgcactcatttgtgcaatttgatcgaggccgacgctgcttgggcgaaaaactccgatggctcatttacggaaaagtatctcaaagtgcgacaggcactggatgatgccgtgagggaatacgagaaccgaccggtcgagcggatgttggaacagcatatgagcgagaagaatcatccgcatctgcggcctcgcgcccgtggacgcaatttcgcccgtgagcttgttaagcagcacttatatgccatttgcgagaaacatcgccacttttttgcgcccggcactttcgaccaagcgatgcgggaattgctgggtgaccagacaggaccaagtcagtggaaactgacgtggatggatcaagacggcaaggcccgacaaacgatcctcgattatcaccggcgcacacgggaagaggccgaagagctttggaagcgcaaagtcaaaaaatgcccgtttgctccattgctgtttgaaaagcggcatccgacgactccacaacacgactgcgctgtccgtagcgacccacgaatccgtcgtttcaacctactgatgttcttagctgaacgacggatcgaactggagacccacgacgcggaaggacgactccaaaatccgcgcgtgaatcttgatgccaacgtcgtccgcgatttgttgggcgatttggagcaagatattcgggcggtcgaagccttgcgaaacaagcagtcagcgtcccgaccagacaaaccggggaagaagacctttgaacagcgatggcgcatctgtaacgactgcggcaaggagactggacaagatgagacgggcaagagttcctgttgcaaagctaagacaaaacccaaaatgccgctcgctggggtcgctaaggggtcgttcaatgctgactttttcgatcagttgggtgacttgttgcgacccgaattgcgttccttgaagggacgggcgagcctgtccggcgaggcggcggaagtgctgttcaagctcgttaccagaaacggtacagacttcgagcctgctagaattcgccaagcgttggaagactgcggctactacgattggcgtaccaatctgccggccggccttggcatctatccgcaagtgacgttcttgttaggaaatcgcggtcattacgacaaggacggcaaccccaggcagatcgacaagacgacaggcaaccccgtacatcacggcatcctgcgccggctgtttgcgggccagttgcgtctcgacgatgggacattggtgggtctgaaggataaactcgacgataaggttgtgcccgattacgtggtcatcgaaaccattggcgagattccgaaaaaccagaaggaaaagaaggagtttcaagacgaaatcaaagccaaccggtcacgaaaaaccgacatcatcgagaagaaatacggtctgaaactcgattcgctttctgactggcaggtgaaacaagtgttgctgttcgaccagcaagccaatgaggaaggcgaagcgttcagcccctacagcggcgtgtccctcggcacaaacccgctggcgcatgatttggaggtggagcacatctaccccgaacgacgcggcggtatcagcgtcatggacaatttggttatcacatggcgcacagaaaaccaaaccaagggagaccgaactccttgggagtgggcaaaagacgagggttggcgggtggacgtccatttgcagaagatgcactggagtgcgaacaagcgcgctctatttgtccgccaagaaagcgatccgccgcagtgggacaacaccacacggatggcccaacttgctcggcatctccgcgccgaggtcatccactggcttggtttagaccagatccaagatcaaaaggagcgtaacaaggaaatcgcccgccgcatcgggacgccgaccggcttccaaaccagcgtttgccgcgagtcgtggacaccaccccatgtgtttccccaaatgtatcggttgctctgcgacaagaagggagtcccggtgcgcgacaggaatggacaagagcgatgggtcaaagaccgcaccaatttgcgacatcacctctgggatgccgctgtgctttcgcatattccaccaggtgtggggctgaattccgccgattgcggcggcattttcgtccaccgtcgcgacccgcagaatggcgaatggtcggtttcggcgttagcggatcttggccctgacctggtggcgtttgaaaaggccaatgccgaccgttgtttagtggtgcgcctgcgccaacgcaaatccaaaaagtcccgttacaaagaaaccatcttcagcctgccggatcaacagaacagggtctttgcacgcgaaccattgagcaaggtcgtcacatctctcttaaagagcaagaagaagaacccggatgcagaattgcggaagctattggaccggccggggcttctcaaccccctcgaaatcacaaacaaaaagacaggccaaacgaaacaaatcaagttgctgaacaaggccgacgtagaacgttggttatcctgcaaagacgtctcactggatcaagaaggattccgcaaattcatcgaggatgtgggcgtgccgacggagcaaatcccagacgacgcggtgaaagcggcgttcatgaagagaaatggcgagacgttacttcgcaagacgttcaagcccaactcccttgtaagttttattcgacagaaatgtcgcatcaaagattcagaaatcgaggcccgtgtggaaatagctatcgccgaacgaaatgaacgcaccgtcctgcgggcggctaacggacgagacggacagcccggtcaagtcatccgcagcattcttatcgagcaagacaagttgccgccatgcggttttggcctacatttcaatcccactgccaaacccaaacgcgggagcgaagtcgctgggttcaagcctgtggacaatagtaattccgttgtctatctgcgccgcgaaatctggatcggccaacgcaccaaaaagaaaggcagaaaaacaaccgtggagaccttctacaagtcgcgcctcatcccacatccacgtcacctcgcttcgtaccagaaacttcacggccagccgtggaaagccgacccgttaccgctaggaatgaaactggccggcaagctggccgttggtgacctgctccgtattccgttgaaaaaagaaaaacgaaatcgcaacgacaatttgatcgcgaagcgcggtgaaaccccgctggagtcgaggttctaccgggtcaagtcaatgaagaccaacggcacgatcgaattccaaatggccgagtttgctgaaccaaagttggtaaaagggcaaatccccgatccggccacggaacggttattggaaacctacgagttgacgtgcagcaacgaggccgatttgctctggttgctggaagtcacgacaggcaagagaatcaaacttccaccgccggtcgtggaaaacgctccgaccactgggaaacgggagggcgaacttctg

SEQ ID NO: 5577 - DNA, 3240 bp, Artificial Sequence
  Description of Artificial Sequence: Synthetic polynucleotide
  MG2-7 sequence codon optimized for E. coli
atgaagcaaggtcagattgcgttcagttttgacattgggcattcatcaatcggttgggcagcgttccaagtgagtgatgcaccgggtacctttcacagtctgctgggtaccggggtagtgttattccctaaagacgcatgtttggccagcgcacgtcgtgggtttcgtcgtagtcgtcgtaatattgcggcacgtcgtagccgcatcgatcgtcttaagaattatctcgcaggccttggtgttctgtcgcgtgatcaattggacgcgaatagcaattcctacccatggttgttggcggctcgcatccttgcgtcggacggtaagaaaaccttaacctgggaagagctgtggagcgtactgcgttggtacgcacataatcgtggatacgatggtaacgcactgtgggccggagacgatgccgacgcgggagacaaggaagatactgacaaagtaaagaatagcattgcacttatggagaagcataagacggcaacaatggctgagacggtgtgtaaagcgttaggccttgatcccatgggagaggttaaagcatctcgtatttactttaaaggtaataacgcagcgtttccacgtggtgttgtaactgaagaggttcgtcgtatccttgcggcacacgctggtaagctcccgaaagttgacgacgcactgtccgacatcttactgcgtaacgcggctacaagtggactggaacttccggcgcgcttcaagggtggtttgcttttcggtcagtatgtgcctcgcttcgataatcgtattatcccggcatgtcgtattaccggcaagaatacgccattaaagcgttgtccagaatatctcctttatcgttggggtcgtcttttaaataatctcactgtctttggtgccgatggtcaaattcgtactttattaccggcggaacgtcaggcgctgcatagccgtatggaagcggatgggttctttacaaagcgtacgttgaacgcggctttaaaggatgttaccggctgcacaccagcgaacacggagtccttcttcttaaccgaggagatggaagaagccttagtgttagatccggtgaagaagcttttggccactaatcaaattatgaaagacctgtggccgcagttatcggcagagtctcgtgagaaagctcagagtagtttaagcgctggtaagaaaattcgcttgggtgacatccttgctgagatggagaccgcaggccaagatactacggcggcgtcggatgcgcttgcgtcgcatcaaaagaaggctaagaagaagaatgcggacctggcgactcgtcgtctgagcgcggactacccgaagggccgcgcggcatattgtcgcgagattctggcgaaaacgtttgatgagtccattagcggaaaggattcgaccaaagagggcgggtgtttatatgagacggaagagattcgtaatcgtctcctgcgcgagcctctcgtgcaacaaacaaacaatcatctggttcgccaccgcctgttggtctttgagcgtctgctggcacatatggtagaagaattcgcgggtggagatgagaagcgtatcgcggctactgttgttgaggtagtccgtgagttgcaagagtttagcggtttaaatagcaaggagattacccacaagttaaacgagaagctcggtaactttcgctctgtggtaaagaatctcgaagaggctatcgcaaatagtgaagagcgcgtggcaatcactggatcactcattcgtaaggcgcgtattctcgaagatcaaggattcgtgtgtccgtacaccgggacccacttaagttataatcacttgcttgccgatcgtctggagattgaacatattatcccgcgttcgttgcgcccgtcggatgctcttagcagttgtgttatgacgtttcgtagcgtaaacgatatgaaaggtcaacgtacggctatgcagtttatttgtgaggaacaaggccgtgaagtgcctggtcatgagaatattcagattaccacgaagaaagcgtatgttgactacgtagcgaaacataagaagcagtatccacagaagagtgatgaccgtcgtcgttgtgagcgtcgcgccgagttgatgttaatggaacgttacgatcaacgtaatgcggattttacagaacgtgatcttacacagactagccatctcaataagatggctattcgtcttgtgaagcaacgtattgggattgatgcgaagcatttaccgggtaatgtgacggcatttattcgtcagaagctgcacatcgatgagtgtttatttaacgcggtgccgcgcttacagacggcggcaaaaggtcagccaaaatccagtaagcgcaagaagaaggcagaagaggctccggtggaacctattcaggatgatatgccgccgcgtaaattaacgaaagcggatattcgtgaattgacttatctccaccatgcgatggacgcagtgacgcagggattagctttgttattatttgcaccggaagattggccgctcttggtaaagcgtaatcttccggacagcgagcagcgtcatctgaaggcccgctacccattcttggacttttcggcagacaaacatattagtattcaggatttaccggaagatactctgcatactatttcggaacgtcttgctgagtgtcgcgtggttcgtcatatcccggcgaagatgcatggtattattgttgatcaaacaacgtggggcacggttgcggctggggctattaccaccctgcgccaaaagactactgaaaagaatgcgcgctgtgacgagaatggtaaacgctttattaaaactacagagaagaagcgtagtctgctgctgggcggtcctgatgcgccagatggcaaacttgcaaagatcaagggtgccattttagttaccgagaattggggttgtgcgctggatccgagcccgacggtaattccgcactttaaagtctaccctcaactgcgtgcattgcgtgaaaagaatggtggtcgtccgattcgcattttacgtaagggctcattaatccaagtgaaagccggcacgtaccagggtatttggagcgttgcaagtattaaagacaacgcagacggtatctgtctggacattaacgccgccgataaagtgaagttagaaaaccgttcagacgacagcaagattaacgttcgcctcgatagcctgcgcaagtctggcctcaaaatcttgaagcccaaactcacaggcgcctgcccgacgacaagcagcccg

SEQ ID NO: 5578 - DNA, 3402 bp, Artificial Sequence
  Description of Artificial Sequence: Synthetic polynucleotide
  MG3-2 sequence codon optimized for E. coli
atgtgcattaacggtgactcgatggccgcagttagcggctttagcccgtgcaagttcgggatcgggatcgacgtgggtgatcgttcggtgggttttgcgactatcgaattcgacgacgacggttttccgctctcggtcttagccagcgtcagttacaaacacgatggcggcctggatcctacgaagaataagaacccgattagccgcaaggcgactgcaggtgttgcgcaccgcgtgcgtcgcatgcgtaaacgccgtcgtcgccgcctggaaatgctggatgtgaagttacgctctctgggcttccctgtcccgaatggcgaggagccgcaaacttaccaagcatggcaaagtcgtgcaaaattaatcgatggccgcgtggacgaagtacgtgaactgaacgaccacctggtacgtgccgtgcgtcacatcgcgcgccatcgtggctggcgtaacccttggtggcgttttccgcaactgcttgaggcctcagaaaaccccagcgacgcgctggtagcgatgcgtcgtgaagcggctcaacgctggccaggccaggcgttagaaagcgccacaatcggtcagctgggttggcttggtgcacacccggatgttttggttcgcccgcgctcggcacgttcggaagttcccgtacttagctcccgtgtcatgcaacaggatcagtgtgcagaaatccgtcgctactggcaactgcaggatctccctcaggaagccctgcatcctatcctgaaagcggtctttcatcaggaaccgccgacggtacctgcggaacgtatcggccgcgacgccttaccggggcaagatgcaccgcgtgcgattcgcgcagcacttgaattccaagaatatcgtattcgtgacgcggtggccaacttgcgtgttcgcaccggcggcgcaaaccgcaaacgcaaactgactccggaagagaaccatgcggtagttaaatacctgatggaatttcgccaaaatccaagcccgtcttgggccgaggtagccgaacatattgacatcgcaccgactagcctgatcgcacctatcattgacgatatgcgcatcgcagcagctccaaccgaccgtagcaccatcaccgccgaagcggtactcagcaatatgaagaaagactcgggcgcccgtttatggtgggaatctgccgaccagaaaatgcgcagcttgttaatccgcttcctggccgacacgtccgactatactcaaccagaggcagagatggcaggtctggtagacatcgtgagcacctggccggattccgaaattgaaaagctgagtagtgcatcatggcaatcgggacgtgccgcgtattccttgcaaagcctggaacgtatgaatgcgtacatggcggagtacagcacgggagcgcacgaagcccgcaagggtgtgttcggagtagatgatagttggaaacccgaggcggatccttgggacgcccagaccgggcagcccgtggtggatcgtgtaatgacgatcgtacgccgcttcgtaggtgcgtgcgagcgtaaatggggcgaaccggagcgtattgtaattgagcacgtacgcacgggtttaatgggtcctgcccagcgtgcagaagtactgcgcgaaatggcaagcgggcgccgtaagaacgatcgcatccgccaagagcttcgtacctcaggtatcgatgagccaaatttgtcggacgttaaacgtcaccgcaagatccaaatgcagggcggcgtgtgtttgtactgtggaaccgacatcacaagcgccactgcggaactggatcacattgtcccgcgcgcgggcggcggaaactcgacgtctaccaatttagtagcagtttgtcgtgtatgcaatgctgcaaagggccgccgcacctttcccgaattcgcaagcagcgacacccgcgacgccgtatcgcttgaagcggcggtagagcgtgtgaaactgtggatcgacgataaaggtattaagaatattggcgaatcacgttatgctcgcgatgtcatccgtcgtctgaaacagtcgacacaagatgaacctatcgatgaacgttcacttagtgcgactgccttcgctgcggttgaaattcgtcgcaaattagaaaaccactttaaagaccgtacaaagccggtgcgtgtggatgtttaccgcggcgcccttacgcgtgaatcgcgccgtgcaggccgcattgacgcgaagatccgtttgcgtggcaacatcgacaaagatcgcctggatatccgccatcatgcgattgacgcggcagttctgacattactggatccatccgtcgcaaagaccctggctatgcgtttagacctgaaacgcgaacagcaggacagcggtcgtgacacgcgttggaaggagtttaagggcttaacaccagcgagccaagaacgttttatcaaatggtgccaagcctcggagtgccttgctgacatgttacgccaacaaatcgaggccgatcgcgttccggtcgtcgtgccattacgtattagcccgagtaatggtgcggtacacgatgattcggtgcgtcccttgacgcgccaaaagattgactcgacttgggaccgtaaatcaatcaaccgcattgttgatccggagattcatgtcgcgatgcgccgcttgcttaacaatgggaccagtctgcccgaggacaagaaccgcgttttggacttacctgacggcaacgagcttggtccgcatgacgaagtcgaacttttcagtacttccgccgcctcaattaagttacgtcgcggcggaagtgcggaaattggcggtagcattcaccacgcccgtgtgtacgcgtggatgggtgctaaaggccaacttgagtatggcatgatgcgtgttttcggtgccgaattccccacgctgactaaattatccggatcaaaagatattctgcgtatgcccatccacgccggtagtatgtcatatcgtgacatgcaagaccgtgtccgcaaacctatcgagagcgatatcgctgtcgagttgggctggattacgcagggtgacgaattggaaattttacctgaagcacacctggaaaccgccggtggcctgggtgactttctcaaaagtttcccggaaacccaatggaccatcgatggcttcaacgacccgagccgtctgcgcgtacgcccgcgtctcatgagtctcgagggacgcgatacaattgatgcgatgggccatctgagtgatacggaaaagctgaaaattaaacaagctctgagcaagggccttatggtgtcagcaagtgagttgttatcgcatggtgctaagattatccgtcgcgatcaccttggccgtccacgttggcgcggtaacgcgcgtccggtcagcattgaattagagcaggtggccaatcaattagtaaaccatcgtagcgtcgacggccaa

SEQ ID NO: 5579 - DNA, 3396 bp, Artificial Sequence
  Description of Artificial Sequence: Synthetic polynucleotide
  MG3-3 sequence codon optimized for E. coli
atgtcagccgactcattgaactatcgcatcggcgtagatgtcggtgatcgttcagtgggtctggcggcaatcgagttagacgacgatggcttccccttaaagaagctcgcgatggtgacgtttcgtcacgacggtggcaaagacccggccacgggcaaaaccccgaaatcccgcaaggagaccgccggagtcgcacgccgcacgatgcgcatgcgccgtcgcaagaagaagcgcctgaaggatcttgacaagaaattgcgtgacttaggttacttcgtccctcgcgacgaggaaccgcaaacctacgaagcgtggtcatctcgtgcccgcctcgccgagtcccgcttcgaggatccgcacgaacgcggagagcatttagtgcgcgctgtacgtcacatggcgcgccaccgcggttggcgcaatccgtggtggtctttctcccagctcgaggaagcttctcaggagccttccgagacatttggacgtattttagaacgcgctcaacatgaatggggcgagcgcgtctcagacaacgcaaccctgggtatgttgggcgcgctggccgcaaataacaacattctgcttcgcccgcgtcgttacgaacacaacccgaagacgggcaagaacgcggagaagctgaacgtacgcggacaagagccaatcttattggacaaagtccgccaagaggatgtgctcgctgaactgcgccgcatttgcaaagtgcaaggcatcgaggatcagtacccggagctggcccatgccgttttcacccaggtgcgcccatacgtcccgaccgagcgcgtgggcaaggatcctctccagccaatgaaaatccgtgccagccgtgcaagcctggagtttcaggagtttcgcatccgcgacgccgttgcgaacctgcgcatccgtgtaggcggtagcgagcgccgtccgctcaccgaggaagagtacgaccgcgcggtcgattatctgatggaatattcggacacaacacccccgacctggggcgaggtggccgatgagctcgagattgctgagaatacattaattgcgccggttattgacgacgtccgcctcaatgtggcgccgtacgaccgcagtagtgccatcgtagaagccaagctgaagcgtaaaacgcaggcgcgtcagtggtgggacgatgacgctaacctggacctgcgcagtcaattaattttattagttagcgacgcaaccgacgacacggcgcgcgttgcggaaaacagcgggctccttgaagtattcgagtcgtggagcgatgaggagaaacaaacgctgcaggacctgaagttcgacagcgggcgtgcagcgtattccattgacaccttgaataaactgaacgcgtacatgcacgagcaccgcgttggactccacgaggcacgccaaaacgtctttggcgtctctgacacttggcgtcccccgcgcgaccgcctggatgagcccaccggccaacccacagttgaccgtgttctgacgattgtgcgccgtttcattttggattgcgagcgcgcctggggccgcccccagaaaatcgtagtcgaacacgcacgcacggggttaatgggcccgtcgcaacgcgccgacgtgctgaaagagatcgcgcgcaatcgcaacgcaaacgaacgcatccgtcaggaacttcgcgaaggtggcatcgaagcaccaaaccgcgcagacatccgccgcaattccatcatccaagaccaggagagccagtgtctgtattgcggcaaggagatcggggtgctcaccgcagaactggatcatatcgtcccccgtgcaggcggcggtagtagcaaacgcgagaatctggcggcggtctgccgcgcgtgtaacgcctcgaaaggctcccgccctttcgcagtttgggccggaccagcccgtctggagcgcacaatccaacgtttgcgtgagttgcaggccttcaaaaccaagtcaaagaaacgcacacttaacgcaatcatccgccgcctgaaacaacgcgaagaggacgaaccaatcgacgaacgttcactcgcgtccactagttacgctgccaccagcatccgcgaacgcctggagcaacacttcaatgacgacttgcctgacggtttcgcgccagtggccgtagatgtatatggcggcagcctgacgcgcgaaagccgtcgcgcaggcggaatcgacaagtccatcatgttgcgcggtcaatcggacaagaaccgtttcgacgtccgtcatcatgccatcgacgccgcggtcatgaccctgctgaatccgtccgttgcagtcacccttgagcagcgccgcatgttgaagcaagaaaacgactactcgagcccgcgtggccaacacgataacggctggcgcgacttcatcggccgcggcgaggcgagccaaagcaagttcttgcactggaagaagaccgccgttgtgctggccgatttaatttctgaggccattgagcaggacacaatccctgtcgtaaatccactgcgtttacgcccgcaaaacggctctgtacacaaagatactgtcgaagcggttttggaacgtaccgtgggcgactcgtggacagacaaacaagtaagccgcatcgtggaccctaacacgtacattgcgtttctgtcgctgctgggacgtaagaaggaattggacgcggatcaccaacgtctggtgagcgtgtcagccggtgttaaactcctcgccgatgaacgcgttcaaatcttccccgaggaagcggcatctatcctcacgccccgcggagtagtgaaaatcggggatagcattcatcacgcccgcctgtacggctggaagaatcaacgtggcgacatccaggttggcatgttgcgcgttttcggtgcggaatttccttggttcatgcgcgaaagtggagttaaagatattctgcgtgtccctatcccgcagggcagccaatcgtaccgcgatctcgccgccacgactcgcaagttcatcgaaaatggccaagccactgaattcggttggatcacgcagaatgacgaaatcgaaatcagtgccgaggagtacctggccactgataaaggggacatcttaagcgacttcttaggcattctgccggagattcgttggaaagtcacgggcattgaggacaaccgtcgcatccgccttcgcccgctgctgttgtcatctgaggcaatccctaacatgcttaatggccgccttttaacgcaggaagaacatgacctgattgcgctggtgatcaacaagggagttcgcgttgtagtgtcaacttttctggccctgccttcaactaagattattcgtcgtaataacctgggaatcccgcgctggcgtggcaacggccatttaccaacctcgctcgacatccaacgtgcggcaacccaagcattagagggtcgtgac

SEQ ID NO: 5580 - DNA, 3402 bp, Artificial Sequence
  Description of Artificial Sequence: Synthetic polynucleotide
  MG3-4 sequence codon optimized for E. coli
atgagcactgacccaaagaattaccgcattggcgtggacgtgggcgatcgttcggtcggactggcggccattgagttcgacgacgccggctttccgattcaaaagctggcacttgttacgtttcgtcacgatggcgggctggatcctaccaagaacaaaacgccggtaagtcgcaagaagacgcgtggcgacgcccgccgcactatgcgtatgaatcgccgtcgcaaacaacgccttcgtgatctggacatgatgttgaccaacttagggtatacagtacccgagggaccggaaccggaaacatacgaagcctggaccagtcgcgctcttcttgcatcgatcaaattagccaatgtggacgaattaaacgaacatctcgtccgtgcggtacgtcacatggcccgccatcgcggctgggccaacccttggtggtcgatcgaccgtttagagaatgcgtcccgcgagcctagcgaaacgttcgaaatcatcttggcgcgcgcccgcgaacttttcggagaaaaggtaccagcagaccctaccctggggatgttaggcgccctggcggcgaacaacgaagtcctgctccgccctcgtgacggcaagaagaagaaaaccggctacgttcgcggcacgccgttattagttgccaaagttcgccaagaagatcaactcgcagaactgcgccgtatctgcgaaatccaaggcatcgagggacaatacgatgcgttgcgttcggcgatcttcactcacaaaatggcgtacgtgccaaccgaacgcgtgggcaaagacccgctcaaccccagcaagaatcgtaccatccgtgccagcttggaatttcaagaatttcgtatcttagacagcgtagcaaaccttcgcgtccgcacggactcacgcagtaaacgcgaactgacggaagcagaatatgacgttgcggtggaattcttaatgtcctatacggcgaacgaacaaccttcatgggcggacgtggccgaagttatcggggtcccggggaatcgcttaatcgccccagtgttagaagatgtgcaacaaaagactgctccgtttgatcgcagctccgcggcgtttgaaaaggcaatgggcaagaaaacagaagcccgccaatggtgggagagcaccgacgatgaccaactgcgcagcttgtttattagtttcctcgtggacgcgaccgacgacaccgaggaagcggccgctgaggcgggcttacctgagctttacatgagttggccagcggaagagcgtgaggttctgagtgacatcgacttcgagaaaggccgcgtggcctactcccaagaaacgttgtcgaaattatcggaatatatgcacgaatatcgtgtgggcttacacgaggcacgcaaagcagttttcggagtagatgacacatggcgcccgcccctggacaaactcgacgaacaaacaggacaacctaccgtggatcgcgtcctcaccatcttacgtcgcttcgtcctggattgcgaacgccaatggggccgcccacgtgccattacggtcgaacacgcgcgcacaggactggttggaccggcacaacgccaagaaatcctgaacgagcaaaagaagaatcgcgaaaacaacgaactgattcgtggcgatctccgcaaaagcggcgtcgagaacccaagccgtgccgaggtacgccgccacctgatcgttcaagaacaagaaagccaatgcctgtattgtggggccgttattcgcaccgacacctctgaacttgaccacatcgtcccccgcgcgggcggtggcagtagtcgccgcgaaaacatggcagcagtatgtcactactgcaactctaagaagaaacgcaccttgttttacgactgggccgggccggtcaaactgcaagaaacagtggatcgcgtccgtcaattagaagcgttcaaagactccaagaaagcaaagatgtttaagaaccaaatccgccgcctcaaacaaaccgaagcagacgtacccatcgacgaacgcagcttggcgagcaccagttacgctgcggttgcagtccgcgaacgcctggaacaacatttcaacgaaggcctggccccagacgacaaatcacgcgttgttctcgatgtgtacgcgggcgcggttacccgtgaaagtcgccgtgcaggcggcattgacgaacgcatcctgcttcgtggggaacgcgacaagaatcgcttcgacgtccgtcatcacgctatcgacgcggcggtaatgacgctgttgaaccgctcagtggcgctgacccttgaacaacgctcccaattacgccgcgctttctacgaacttgaacttgacaagctcgatcgcgaccaactcaaacccggtgaggactggcgcaatttcacgggattgtatgaagcctcacaaaacaaatttagcgaatggaagaaggcggcaaccgtgttaggggacttattagcagaggccatcgaagacgacgcgatcgcagttgtttctccgttgcgcttacgcccccaaaacggtagcgtccatgacgataccatcaacgcagtcaagaaattaaccctgggctcagcgtggccggcggacgcggttaaacgcatcgtagacccagaaatctatctcgccatgaaagatgttcttggcaagctgaaagaattgccggaagactcagcacgtagtttagaactttctgacggtcgttatatcgaagcggacgacgaagtgttgttctttccaaagaaagccgccagcatcctgaccccgcgcggtgccgcggaaatcggcaacagtatccaccacgcccgtctttacagctggcttactaagaaaggagagttgaaatttggcatgctgcgcgtttacggggctgaatttccttggttgatgcgcgagagtggcagtcgcgacgtgcttcacatgccgatccaccctgggagccaaagttttcgtggtatgcaagacggggttcgtaaagctgtggaatcgggtgaggccgtcgaattcggttggatcacccaagacgacgaactcgaattcgacccagaggattatatcgcccatggcggcgacgacgaacttaaccgcttactgcgcgtcatgccagaacgtcgctggcgcgttgacggattttacaacgcaggcacactgcgcatccgtcctgccctgcttagtgcagaacaactgcccagcgaactgcaaaagaaagtggccgacaaaacactgtcagatgtggaactgatcctgctgcgtgcggtgcaacgtggactgttcgtggccatttcaagtttcctgccattagaaagcttgaaagtaatccgtcgtaacaatcttggctttccgcgctggcgcggcaatggaaacttgccaaccagctttgaagtgcgcagcagcgcacttcgtgcgttgggcgttgagggg

SEQ ID NO: 5581 - DNA, 3009 bp, Artificial Sequence
  Description of Artificial Sequence: Synthetic polynucleotide
  MG14-1 sequence codon optimized for E. coli
atggaaattacaattaaccgtgagatcggcaaattaggcttgcctcgccacctggttctgggtatggacccgggcatcgcctcatgtgggtttgccctgattgatacggctaaccacgagattctcgaccttggagtgcgcctcttcgattcgccgacccacccgaagaccggacagtctctggcagtcatccgtcgtggatttcgttcgacacgccgtaatatcgatcgcactcaagcccgtctgaaacattgcctgcaggttctgaaagcctacgggctgattccgcaggatgctacgaaggaatattttcatacaactaagggtgataaacaacctttgaaactgcgtgtagacggactggatcgtcttttgaatgaccgtgaatgggccctcgttctgtatagcctgtgtaaacgtcgcgggtatattccacatggcgaggggaaccaagacaagtcgtctgagggtggtaaagtgttgtcggcgctggccgctaataaagaggcgatcgccgaaacatcctgtcgtacggtgggtgagtggctggcccaacaaccgcagtcccgtaaccgcggtggaaactatgataaatacgttacccatgcacaactgattgaggagacccacattctgttcgacgcgcagcgttcattcggatctaagtatgcgtcccctgagttcgaagcagcctacattgaagtgtgtgactgggaacgcagccgtaaggattttgatcgtcgtacttatgatctggtaggtcattgtagctactttccgaccgagaagcgtgcagcgcgttgtaccctgacttccgagcttgtgagcgcttacggtgcgctgggtaatattactattattcatgagaatggcacatcacgtgctttatcggcgaccgaacgtgacgagtgtatcgcgattttattttcttgtgaaccgatccgcgggaataaggactgcgcggtaaagtttggtgcactgcgcaaggccctggatctgtcaagtggagactatttcaaaggcgtgccggcggcggatgagaagacccgtgaagtatataaaccgaaagggtggcgtgtcttacgtaacacacttaacgccgcgaatccgatcctgttacaacgccttcgtgacgatcgtgaccttgcggacgcggtaatggaagcagttgcgtactctagcgcactgccggtcttgcaggaacaattgcaaggactgccccttagcgaggcagaaattgaagcactgtgtcgcttaccgtacagcagcaaggccttaaatgggtacggtaatcgcagcaagaaggctttagatatgttactggactgtctggaagaaccagaagttctgaatttaacccaagcagagaacgattgtggcctcttaggtttacgtattgccggtgcgcaattagaacgttcagaccgtttaatgccgtacgaaacgtggattgagcgcactggccgcaccaacaataacccagtggtgatccgtagcatgtcacagatgcgcaaggtagttaatgctatttgtcgtaaatggggagtaccgaatgagattcatgtggaattggaccgcgaactgcgtctgccacagcgtgcgaaggatgaaatcgcaaaagcgaacaagaagaacgaaaagaaccgtgaacgtatcgcaggccagattgcagagttacgcggatgtacagctgacgaagtgaccgggaagcaaatcgagaaatatcgtttatgggaagaacaagagtattttgacttgtatacaggtgccaagattgaggttgaccgtctgatctccgatgatacgtatacccaaattgatcatattttgccattttcgcgtactggcgagaatagtcgtaataataaggtgttagtgctggctaagtcaaaccaagacaagcgtgagcaaaccccgtatgagtggatgtctcatgatggggccccgagctgggacgcgttcgaacgccgtgtgcaagagaatcaaaagctgagtcgccgtaagaagaattttctgttggagaaggatctcgacacgaaagagggagagtttctggcgcgttcttttacggatacagcatacatgagtcgcgaggtgtgtgcctatttagcagattgcttattgtttccggacgacggtgcgaaagctcacgtcgtgccgacaaccggtcgtgctacggcgtggttacgccgtcgttggggtctgaatttcggctctaacggtgagaaggatcgttctgatgaccgccatcacgcaacagacgcgtgcgttatcgctgcctgcagcccgtcgctggttatcaagacggcgcgcattaatcaggaaactcattggagtattacgcgcggaatgaatgaaactcagcgtcgtgacgctattatgaaagccctggagagcgtgatgccgtgggagacattcgccaatgaggtccgtgccgcccatgactttgttgttcctacccgtttcgtgccacgtaaaggcaaaggtgaactctttgaacaaacagtgtaccgttacgcgggtgtgaacgcgcaaggtaaggatattgcgcgtaaagcgtcgagtgacaaagatattgtgatgggtaatgcggtagtatcagccgatgagaaaagcgtgattaaagtttccgaaatgctttgtttacgcctgtggcacgatcccgaagcgaagaaaggtcaaggggcgtggtatgccgatccagtgtacaaagcagacatcccggccttgaaagacggcacctacgtaccgcgcatcgcaaaagcacacaccggtcgcaaggcgtggaagccggttccggagagcgcaatggcgaaaccgcctttagagatttatttcggcgaccttgtacagattggtgactttattgggcgcttctctggttataatattaacaacgcgaattggtcattcaccgatcgcctgactcgccttaatttgtcatgtccgacggtgggccagctgaataatgatctgagtccggtcgtgattcgtgagagcccgattaag

SEQ ID NO: 5582 - DNA, 3246 bp, Artificial Sequence
  Description of Artificial Sequence: Synthetic polynucleotide
  MG15-1 sequence codon optimized for E. coli
atgaactatgtgctcggcctggacgtcggtattgcttcagtgggatgggccgtgcttgagttgaatgaagaggacaaccccattcgcattgagggtcttggtgcgcgcatcttcgataaagcggaagtgcccaaaaccggggccagtctcgccgcacctcgtcgcatgagtcgtggcatccgtcgcgtgattcgtcgtcgccgctttcgcttacaacgcgtccgctcatacctgaagaagcacaacattctccctgccgagaaggttgatcacttatacgacgttccatctgccatcgacatctacgagctccgtaagcgcgcactgactgagaaggtcacagccgaggagtgggcgcgcctgttaatcttcttcgcgaaacaccgtggtttcaagtccaaccgcaagaaggcttcgggagacgccgacgagggcgagatgctcaaggcgatcgcagcaaacgccgaaatcctgaagaactatcgtacagtgggagagatgctgtgcgacaacgagaagtttcgtaaacgtaagcgtaatcgcgatggcgcatacaactttactgtctctcgtgcgatgctgatggaagaaattcacacgctgttcgagattcaacgcaacttgggccagaagttcgcggacgagaagctggaagaggagtacgtgatcctcttcgccgctcaacgtaaattcgatgaaggacctggagaaaattcgccgtacgcggggaaccagattgagaagatgatcggttcctgcacgttagagggcaagaaagagaagcgtgctccaaaggcctcatacgcatttatggcatttaatttatggcaaaagatcaatcacttgaaagtcaatcgtcgtggtagtgaacgcttcctgaccgaagaggagcgccgccgcattgcggacctggcgtggaagaaggagaagcttacctacggttcactgcgtaaggtgctctcgttggaccccgaggatcgcttcgttggcctgcgttacgacctcaagaaaggcaaggccgagaacttagaagaacccgtttctgaggcagaaaagcgttccttttcatgggtcaaggattatcactccattcgtaaggcccttgacaaggtggagaagaatcgcattttgaagctctctcacgagcaactggacacaattgccaccgcgtttagtgtttacaagaacgaagagaccattgaaaagtacctggaagagggcggcattggtaaggccgacggtgaggcgctgcttgagcgtttgagcggatttagcaagtttggtcacctgagcctgaaggcgtgttataagctgctgccgttcctggagaagggcgaggtgtactcacgcgcttgtgagttggcggggtacgactttagtaaatcgtccttggagaacattgacgacattccgaacccggtcgtaaagcgctcgatttctcagacccttaaggtgattaacgcgatcattctgcgctacggcaacccagttgaggttcacattgagttagcacgtgagctcgcccgttcttttcgcgaccgcaagaagatggagaagggtatgcaagagaaccaagcgaagaacgagaaaattcgtcagcgcctgattagtgagttcggggtgctgcgcccaaaaggcatggacattgttaagttcaaattatgtgaggaacaaaacggggagtgtgcctactcgcaaaagcactttgacatggaaaagttacttaaggacccgagttacgccgaggttgaccacattatcccgtactcacgctcattcgacgacagttataacaacaaggtgctggttctgacgaaggagaatcgtgagaaacgtaatcgtatcccgatggagtacctcgccgacgcgcctgagcgcaagaaccgtttcattcactgggtcaaatccacaatccgcaatagtcgcaaacgtgagaatcttctgcgtaccgattacacggcgactaccgagaatgagtggaagcgccgtaacctgcaggacactcaatacatttcgaaatatttatataactacctgcgccatcacctggtccttgcgaaaggttacacagagcgtaagcgtcgcatcattccggttaacggtgctgtaaccgcatactttcgcaaacgcctgggtattaacaagattcgtgagaatggcgacctgcatcacgcggtggacgccgttattattgcgtgtgccacacagggaatcgtcaacaaagtttcccgctatagtaaatcgcgcgaactctgggactacgaggtcgacatggagacgggtgaggtgctgcagaagaagaacaagaataccaaggatgtctttccggagccgtggcttaactttcgttacgagttggagcagaaggttcgtgtgcgccccttggacattcccgagacggcagacatcacggagatggaagagccgttcgttagtcatatgcctaaccgtaagatccacggtcctgcccacaaagagactatccgctctggccgccttaaagaggaaggttacacaatcagcaagaccgctctcatcgacttaaagcttactgaggacaaggaagagattaagggctattataacaaggagtcggaccgccttttgtacgaggctttaaagaagcagctgcagcgctacggtggcaaagctaaggaagcgttcaaggagccgtttcacaagcctaaagcagatggtaccccgggcccaatcgttaacaaggtaaagatcatggagaagagcactatgttaatcccggtgaacggcgggaagggtctcgcgtcaaacggcaacatggttcgcatcgacgtctttcgcgccgaggagaaaggtaagaagaaatattacttcatcccggtttatgttgctgacactgttaaggaagagcttccgaaccgtgcggtcttggcccacaaaccatacgaagcctggaaaattatgaaggaagaaaacttcatcttctccctctacccgaacgaccttatcttcgtcgacgccggtaaggaaatcccgttcaaagccgcactgaagggtagcacccttgacccggaaaagaaagcatcgcgtttcctgatgtactacaaaggggccgacatcgctaccggtagtattagtggcgtgaaccacgacgaaacctacaaagcacgcggcgtaggtattcagtcactgcgcgagattaagaaatgttgcattgacgtgctgggcaacatcagcttcgcttccaaagagaagcgccaaacgttccgt

SEQ ID NO: 5583 - DNA, 3681 bp, Artificial Sequence
  Description of Artificial Sequence: Synthetic polynucleotide
  MG16-2 sequence codon optimized for E. coli
atgaagcgtatcctggggctggatctgggcacaaatagcatcggctgggctctggtggaagtggacgaggacggtaagattatcaagatccttggcatcggttcccgtatcatcccgttgagcccggatgacgcgaacgaattcacgacgggcaagagcatcacgaagaatcgcaagcgcaccgagcaacgcaccacgcgcaagtgtttcgaccgttaccagctccgccgcctgttgttaaccatcgaacttcgtaagtttaacatgctcccggacgaacgcttaattaagctgccggtcctggacctttggcagctgcgcgcaaaagccgcgacaaagggtaaccgtctgaccctgccggagctgggccgcgtcctgtaccatctgaaccagaagcgtggctacaagcacgcgaagagcgacgagtctaacgacaagaatcagcgcgagtacgtggccaacgtcaacacgcgctacgccaacattaaacaactgggtaagaccattggccagttcttcgccgagaagcttgaagagaaccaggtgattactgagaagggcaagttctacacctaccgtatcaaggaccaggtatttccccgcaaagcgtacgaagaggagttcgaccagattatggaatgtcagcgcgagttctaccccgaaattctgaccgacaagtttattgacaaggtgcgtaacgagatcatttactaccagcgtaagcttaaaagctgcaaacaccttgtgagcctttgcgagttcgagaagcgcgcgtacgtcaacaaagacggcaaggtagtgtacgacggtccaaaggtagcaccgcgcacctcgcctctcttccaggtgtgcaaaatctgggaaagcgtgaacaacttgaagattaagaaccgcaagaacgacgagctgtacattacccaagagcagcgcattgcgatgtttaatttccttaacaataacgagaaaatgacccttagcgacatgtacaagatcttgaagatcgataagagcgatggctggtggggcggaaaagcgattggtaacggcctgcaaggtaacaccacgaagatgcagttaaagaaggccctgtcgaactgccagaacgttgacgagctgcttcagttcaacttggacatcgtggactcagataagattgacgaggagaccggcgaggtgctgaaggtagtgtctcctaactgtgagcaggagccactgtacaagctgtggcacacaatctacagtatccaggacaagaacgagctgaagaacgtcttacagaagaagtggggtatcacggacgagaccaccttaaacagcctcttcgcgctggacttcgtgcgccccggctacggtaacaagtcgagtaagttcattcgcaagattctcccttacttacaagacggtctgatgtacaacgaggcgtgcgcttatatcggcgtcaaccacagtaactcgctgacgaaggcggagaacgacgcgcgtgagctgctggagaagctgccgcaaatcaagaagaatgagctgcgccagccggtcgtagagaaaatcctgaaccaaatgatcaacgtggtaaacgcgattttcgacaagtacgggaacaacaacggaatcgacgagattcgtgtggagctggcacgcgagttgaagcagagccgcgaggagcgcgagctcaccgacaagaacaaccgcaaccgtcagaaggagaacgattcgaacgcgaaactgattgaagagtacggcatccgcgcatcccgcaaccgtatccagaagtaccgtatgtggaaagaaagccgccagacctgcttttactgcggccaggtcgtggacgtgaaggacttcttgcgcggttacgacgttgaagtggagcacatcatcccgaaagctctgttcttcgacgactcgttcagcaacaaagtgtgcagttgtcgcaagtgcaacagcgaaaagggtgagcgtaccgcgtacgactacatgagctcaaagggagaggacgagctgaaccgctatatccgtacagtcgaggatcgttgcaagaagggcgaaatctcgaagacaaaacgtgagcgtctgttaacgccggccgacaagattccaacggacttcatcaatcgccagcttcgtgagacccagtacatcgcgaagaagagcgttgagatcctgaagcagatctgccgcaacgtttggaccacctctggtagtgtgacagacttcttacgtcacaactggggttatgacgaaatcttgcacactctggacttcgatcgctacaagagcggtggcctgaccgaggtaatcgaaatcgagcacaagggccagaagcaccgcattgagcgcatcaaggactggagcaagcgtctggaccaccgccaccacgcggtggacgcccttgtggttgcctgcaccaagcagagctatatccagcgcctgaataacctcaacaccgagcgcgacgccatgtaccaagacatcgaggcgcagagcgtcgagtggaaggagaagcacagcttgctcgagaaatggatcaagttacagccgcacccgacggtgagcgaagtcacagacaaggttgacgagatcttggtatccttcaaagcaggcaagcgcgtagccactctgggtaagcgcagcgtttacaagaacggcaagaaaaccgtggtgcagaacaacattatcgttccgcgcggggcactctgcgaggagtcagtatacggccagatcaaccttatcgagaagaacaagccgattaagtatttgttcgagaacccgagcctgatcttcaagccgtacatcaaggccctggtcgaggaacgcttaaaggagtacaatggagacacgtcgaaggccatcagcagtctcaagaacaatccgatttaccttcgcaaagacaaatcagtagtgcttgagtacggtacctgttataagaaggagtacgtaaagaagtactcgctgaactccattaaagctaaggacgtggacagcatcatcgataagcacatccgcgaagtggtccgtcagcgtctcgaggataacaataacaacgagaaggccgccttcgcgagcccgctgtacgcggataagcagaagcagatcccgatcaagagcgttcgctgtaccactggcatcaacatcgccgcccccgtaaactacaacgagtctaacgatccgatttctttcgtgaaaccgggcaacaaccaccacatcgccatctacaaagacaaagacggcaagcgtcaggaacacattgttaccttctggcacgcggtggagcgcaagaagtacggcatgcccgtagtcatcaccaaccccaaggagatttgggacctcatcatcgagaaaagcttggacttgccggagagtttcttaaactgcctgccgaacagcgactggaactacgagatctccatgcagcagaacgagatgttcgtgatgggcatgagcgaagacgagtttcaagacgccatccgcaataacgactacaagacccttaataagtacctgtaccgtgttcaatcggtcagtgagagcgactactggctccgtctccatatcgagaccatgaacgacaagacgcctgagggtaacatcatcaagaagtactaccgcattaagtcaattaacaccttcttcaacttcaacccgcacaaggttaaaattaccttgctgggtgagatccagagtagt

SEQ ID NO: 5584 - DNA, 4044 bp, Artificial Sequence
  Description of Artificial Sequence: Synthetic polynucleotide
  MG18-1 sequence codon optimized for E. coli
atggaccagagtaaagagtactacattggtctggatggtggtacggactcggtcggatgggcggtactcaacccggactataccgtcgtgaagaagcgtggtaaaagcctttggggcgtacgcttattcgagagtgggcagacggcggcggagcgtcgtttagcccgttcggcgcgtcgtcgtacggatcgcaagaagtggcgtctgaaacttttaaaggaactgttcgcggaagaggtggctgcgtgcgatcccgcgttcttcgcccgtctggcagagtcccgttactgggaagatgacaagaaagttgatggtgcggatactttattccatgacgcggacttcaccgacaaggattaccatcgtcaattcccgacgatttaccacctgcgccgtcatttaatgtgttgtactgagaaaccagacattcgtctcttgtaccttgccgttgcccatatgattaagaaccgtggtcacttcttgaatgagggccaagacttgaaccaagtccgtcgtttcgatgacgtatggcagaatctttgtgcggctgtatcggacgttttagggatcgagttagccgtcgagaatggcgcgaaggccgctgaagtattaaccagcagcgttaaaattaaggaaaagacgaaacaattggaatcagtactgggcgagggtgagtcggaagcggatcgtagtgtttgtaaagccctggctggtttacttgcgggtgcgaaagtttcagccgtagacttattcaatggtgatgaggcattgaaagaatgtggaaagttttcactggcggagaagtcgatcgaggagctcgaacccgacctgggtgacgccttgggcgaggaacgtttcagccttttacaatacgcctacgcggcttataattgggccgtgttcgctcgtctcctgccagaaggcaagacaatttctgaggttaagacagaagagtatgaggcgtataaagcggaccttcgcgcattaaaacaattagtgaagcagtacgccagcgaccagtactatcgcgtctttcgtagcgcaaagattaaaggaaattatgccagctacgtaggtaagaccaactgtggaaatgagaagtcgaacccggagtcgtgtaaaccagaggagttcttcgcgttcctcaagaaggaattaaaaccactgtggtcccagaatatccccgccgccgcgtcactggctgcgaaattagagagcggcactttactccgtcgtcaacgctccggtgaaaatgcggccattccgtaccaagcccaccttcaagaattacaaattatcttaaagaacatgcaacaattttacccattcctgcagaaggcggacgagaatggtttcacccctgcatacaagatcgagaaactcttgacgtttcgtatcccttactacgttggtccgttaaacgacgcacataaagagaagggattctgttggatcgtcaagaaagcggacgttccagtgctgccctggaacttcgaccaagttgtcgatgagaatgcatgtgaggacgctttcattggccgtatgtctgcgacgtgtacttacttagtcggtgaaaacgtacttccccaaaactcgccactctattgtcgcttcatggtcttaaatgaattaaacaacttacgtatccgttcagagaaaattacgccggctttgaaacaggccatctttacacaattattttgtgctgggaagggtggtaaagttactcaaaagaagctcttggacttcttacacagccaaggtatcgacgcgaataaacaagacatttcgggtatcgatggtgacttcaaggcgtcgatggcgccagcagtgaaacttcagtctatctttactgaaccgttgccgcctgagatcctcgagcgtttagcatttgcacttaccgtgtcaggagagtctcacaaaatgttgcagaatcgtatccgtgccatccttcctaacgcggataacgcggtcattcgtaaggtgtgtgcgctcaagtttacaggatggggacgtttatcgcagaaacttctgactgaaatctacgacgtcgatcagactacaggggagtgtcgctccctcatggacttgctttggagtaccaataataaccttatgcaacttttatcaggcgacttcaccttcgcagcgggtattgacgcgtacaacgcggctcagaatggtaccgagaatatcttcgactacgatcacttggttaaggacttgtacgtctcaccgtcagtcaaacgtggtctgtggcagaccctgctgctggtcaaagaggtccgtaagattatgggttgcgatccggcccgtgtgttcattgaaatggcacgtggagtaagccctgaacagaagaataagcgtactgtaagccgtaaagaccaattactggccctctacaaggcatgtaaggaagacgcacgtgattggtgtggtgaattagaagcgttaccagaagataaattgcgttcggataaactttacctctactatacacaaatgggacgttgcatgtattcgggagagccaatccgtttagatgatctgatgcatgatacggcaaaccaactttacgatattgatcacatctaccctcaatccaagactaaagacgattcgctcactaatcgcgttcttgttaaacgtcaattgaatgcaatcaagtcgaatgactaccctttaccccagactatgcgccagaccgctctgtggaaggcactgctggagaagggcctcatttcaaaacagaaatacttacgtttgacacgtacgactcccttcactgaggaagagttggctggtttcattaatcgtcaattggtagagacccgtcaaagcactaaagcggccgcgcacttattggaacaattgctcccaaatacggaagtggtatacgtgaaagctggcttggccgccgactttcgtcaagagtttggcttcgttaaatgtcgtgacgcgaacgattttcatcatgcaaaagacgcatacttgaatgcggtcgtcgggaacgtctatcatgaaaagttcacgaagaacccattgcgcttcgttcgtagtggccaagagtattccttaaacttaagcgccttatttcagaattggaatatctacaaaggcggccgtgttatttggcagaaaggagaggatggtagcctggagactgtacgcgcccgtatggcgaagaatgatccaatggtcactcgttactgtacagaaggccgtggagcgctgtatgatttgcaaccgatgaagaagagtaaaggtcaactgcctcttaagtcgtcagacgagcgtttgcaacacattgatcgttatggcgggtacaataagctggctggcgcgtatttcacgttagcggcatactataagaagggtaaacgtgttaagtcaatcgagtcggtacccttatacctcgcggcaaaattgcaacgtgaccccgccgcactccaacaataccttgcagatcagctcggaacggatcgcgttgagatcctcgtacccgaaattaaactgggtactttatttaaatggaatgggtacccaatgacgttatcgggccgcacgggaccccagctgttatttcgtaacgcggccgagttacgtactaatgcagaacaagagcaatatattaagaagatgagtcgctacctggagaagtgtaaggggcgtaaagaacctcttccgattcgtccggcatacgataagttaacccccgaagagaatttacaattatatgacgcctttacacagtggttgactagtggaatttacgcgaagcgtctgagtttgcaagggaagtttcttcttgaaaagcgtgacgcgttcgccgcactgtcgccggaagcgcaagtccgccaattaatggaaattcttcacctgtttcaatgtaatccggtcgcagctaacctgtcggaactcggtggggctgcccatgcggggatcctgttggcaagcaagaacatcgatggtaaagtcccggtatcgattgttcaccagagcgtgactggttatttcactcaagaggtgtgtttaaatgatctg

SEQ ID NO: 5585 - DNA, 3294 bp, Artificial Sequence
  Description of Artificial Sequence: Synthetic polynucleotide
  MG21-1 sequence codon optimized for E. coli
atgaccagtcacagcatccgttatacccttggtttggacatcggaatcgcgagcgtgggatgggccgtccttcgcaacgggagcgactccgaaccttaccgtatcgaaacccttggtgtgcgtatctttgataaggctgaagtaccgaaaactggcgcaagccttgccgcccctcgtcgtgaggcccgttcatcccgtcgcgtagtccgtcgtcgtcgccatcgcaaggaacgcattaaatacctgatcgaacaagagggcattatgacccaggccgagatgacccgcttgttccagaacagctcgttcgagaagagcgtgtacgagattcgcgtagaggccctggaccgcatgctgacccgtgaagagacggtgcgtctcctcatccatttcgcgcaacgccgtgggtacaagagtaattcgaaggcagaagaggcgaaggacaatgaaaatggtgtgattaaacaggcaattagccaaaacaaacaggcaatgaaggcccacggttatcgtaccttcggagaaatgttattgatggacgagcgcttttactatacccaaccagatggttctcgtatctttatcccgcataacaaggcgagtgattataaggtgactgcggaacgtagtatgttggccgacgagttacacatgatcttcgctgcgcaacgtagtctcggttccctctggttcagcgacaccttcgagacagcatacatggacgtgtggagctcccaacgttccttcgatgagggcccaggcggcgactcaccgtatggtggctcgcagattgagaaaatgttagggacctctagcgacggcgagagccgcgcccctaaagccagctacagcgcggaatacttccgcctgctccaggatgtgaaccatctccgtatcgtgagcttagacggtacctcaagtcctctgacccaagagcaacgcgacattgtagtggctgcgagtaagaagagtggtaccttgacatacacccaattacgcaagaagctggctctcgcagatgaccaatactttaacgccctgtactacggcgataaaactgcagtcgaggtggagaagaagcgttttggtcatctgcagttctaccaccaactgcgtaccgcccttgacaccgtcgagaagggcgctgccgacacgctgacgtgggcccaacgcgacgaaatcgcacgcatcctgacagtttacaaggcggacgttcgtcgcaccgacgagttacgtaaagccggtatcccggcggagtacatccgcgccctgctcccattatcgccgacccgtgcgatgcacctgagtgtgacagctattcgcaagatgatccctcacttagaagccggtatgtcgtatagcgacgcctattccaaggcctatggcaaccaatcgacggcgtccgcagccccgaagaagaacaaactctcactgaacgatatcgaagagatcaccaacccggtagtacgtcgcgcggtcagccaatcgattaaagtgattaacgctatcgttcgtcagtatggcgcaccagagcgcgtgcgcatcgaattggcgcgtgagatgggtaagaattttaaggatcgtggcaaaatcgcaaagagtcaggccgaccacgcggctaagaatgagcgcatcaaagcccaaatctcagagtacaagagtgatcatattacgggccaagacattgttaagtttaaattgttcaaggaacaagatggcatttgcttatattcgggcaagtcgcttgatatcgcccgtcttttcgagccggggtacgtggacgtggatcatatcatcccgtactctatcagcttcgacgattcatacaataataaagttttggttttaagtagcgagaatcgccagaaaggcaaccgcatcccgtacgcatactttggccagaatagcgaccgttgggagaagtatgagacgcttgtatcaaataccgtccgcagttatcgtaaacgcaagaatttgcttctgaaaagccttagtgaagcccaaatcgacggttttaaacagcgtaacctgcaagacacccagtatctcagtaaagtaatctttcgccttattgaaaatcatctccaattcgcagagaccgctccgggcaagaagcacacgcaacccgttaacggtgcgattaccgcgcaagtgcgtaaacgtttgggcatcgaaaagattcgcgaagatggtgacttacaccacgcagtagacgcggccgtcatcgcgtgcatcaccccgggcatgattcaaaagatcaccaagtacgcgcagaaccatgaacgcttttacgccactgccaagggttacgttgatatcgagactggtgaggtgctgacccgtagtgaatacgaagcgatggacgacattcgcttcccggagccatggccggggtttcgcagcgagctggaagctcgcgtgagtgaacacccacaagaggcgatcgcgcgcctgaaattgccccattacgagaatagcgaagaaattcgccccattttcgtgtcgcgcatgccgaaccacaaggtcaccggcgcagcacacttggagactatccgtagtaagaaaggtggagcaggctctaccgtaactaagaccgccttgccggacctcaagttggataagaatggcgagatcgcaggctactatcgcaaggaagacgatccgttactgtatgaggctctcaaagcccgcttgaaagcgttcggcggagacggcaagaaggccttcgccgaaccttttcacaagccgaaacataacggtgagccgggccctatcgttaagaaagtcaagatccaagagtccgcgacgctgaccgtacccgtcaaccatggtatcgccgcgaacggctccatggtccgcttagacgtgtttcacgtcgatggtgacggctattacttcgttcccatctacacttcggacaccgtgaaacccgaattaccgaaccgcgcggtcgtcgcggggcgccgtgtccaagaatggaaagtgatggacgatagttactttaaatttagtttatacccgaaggatttaatccgtattcgcagtaagaagggtatcaaactcaaagcggtgaatcgcaacgccgaccttcaagaatacagcactaacgattgtctgtgttattttgtcaagttcaatatctctactggcgcgctgagcgtagagaatcacgaccgtaagttcgaacagcccggattgggtggtaaaaccctcttatcaattgagaagtaccaagtagacgtattaggaaattacagcccggtagccttaccagagaaacgcatgaaatttcgc

SEQ ID NO: 5586 - DNA, 4563 bp, Artificial Sequence
  Description of Artificial Sequence: Synthetic polynucleotide
  MG22-1 sequence codon optimized for E. coli
atgacgaagaatactcgtaatattatcggtctggatctgggcacgaactccatcggttggtcatggatccagcaactcattagcccgacaccgacccagccatcggagtacttgttcgatggcacccccatcatccgcatgagtggttcccgtatcatccctatgccgggtgacgtgaccgggtcattcgaacgtggagagactattagcaaaacgaaggatcgtactgccaaacgtatggcccgtcgtatgaatgagcgtttccagcttcgtcgcgagcgcttgaatcgtgtattaaacatcatggggttccttccggaacattacgctcgtgccctggatcgttatggtaagctgaatgaggagtctaatactactattgcctggcgttcgaaagaggatggtaagaacgagtttatcttttaccctagcttcttggagatggcctcgatcttcaaagaacatcatccggacattcagcgtatcccccttgattggacgttgtactacctgcgttctaaggcgttgcatcaggcgattactaaagaagagctctcctgggtcttgcactcatttaaccaaaagcgtgggtattaccagagccgtgaggatattacggaagaggataagaccaagaaagtggaatatattaagggcgtggtgaatagcgtcgaggatacgggcgagaaggccaagggtaagaagatctacaaggttacatttgcggacggaaccgaattcacctcgacgaaaagcgaggcaccactgtggatcggtcgtacgcgcgagattatcgttaccactagcctggatacttcaggcaagccgaagttagataaagagggtaagattatccaatctgcgaagaccccggacgaaaaggattggacgcttattaaaattcgtactgaggcaacgattgacgattctaagttgactgttggcgagtatatcttccatgcgctcctgaagaatccggaaacgaagattaagggcgcgcatgtttctacaattgatcgccgtttctatattaatgagattaatgcgattttgaaggaacaggagaagtatcacgaggagctgcgcgataaatcactgtatgaacaatgcacacaggcgctttacgcgcagaatgaggtgcgtcgtaatattattgcgccgtggtctatgagcgatcttctgatcaaggatattttattctatcaccgccctctcaagtctaagaaatcacagatcagcgagtgttcgttagaattccacacgtacacggataaggatggcgcgacccatcgtcagggaattaagtgtattccgaccagtcacccactgttccaagagtatcgtatctggcagtttatcgcgaatttacgcatctatgagcgcgaacgcttcgataatggaaaacatttcattaacgaggatcgcacgagcgacttcttaaccacgaagaagaaggaagagctgtacgagtggttagcagaaaaggacagcgttagtcaaaagacgctgcttggccatctgggcttaaaagtggagcgctaccattggaactttccggaagaaaagacttacccgtgcggcgagactcgtcacctcatccaatcacgcatgaagaaggcgaacctgcaaaaggcgtttcacagcctcatctcggacgaacagaaggactgctttgagcgcggcctgtggcacattttatacagtgttagcgattacaatgaactttgtaaagccctgaagaccttcgcgcgtaagaccggctttaccttagaggagcagtcgttgttcgtcgaggcattctcgtcgtgtcccccatttaagaaggattatggcgcatatagtaagcgtgctattacgaagctgctgccactcatgcgtattggcaagttctggcatgaggagagcattgacagtaccaccaaaacacgtatcgagcaccttattagcggcgaagagtgttcaggtattgatgtgcgtgtgcgcgagaaggtgacgaaggcgggtctgtgtgagtctatcgagcagtaccagggccttccgcagtggcttgccaattacgttgtatataatcgccacagtgaggctagcgagattacaaagtgggagtcgccggatgagctggataactatattcgtagctttaaacagtactcgttgcgtaaccccattgtcgaacaagtgagcttagagaccttacgtgttgtccgcgatttatggaccgagctgcagaaggaaggacagactatcgatgagattcacttagagatgggacgtgatctgaagaatacggcggaagagcgcagccgcatcttccgtcgtaatagtgaaaatgaggacacgatcttccgcattaaactgttattagaggaattctatgcgaatgagaaggatatcaaggatgttcgtccgtacagtccgtctcagcaggaattgttgcgtatttatgaggaaggtgtctggcagcaggagaaggacatcccacaggatattaaagatatcaagaagcgcatcagcaatgataaagatatcaaggatattaccccgaatgatattcagcgttatcgcatttggatggaccaaaagtactgctcaccgtatacggggaagaccattccgcttagccgcttgtttacaactgattatgagattgagcatgtaatcccccgcagtcgttacttcgatgatagctacaacaacaaagtgatttgtgaggcggcggttaataaggataagaataatcgtttagggatggagtatattatggccgcgggcggtaagacaatcgagctgggaaatggcaagaatgtgcagatcttaaaagaggaagagtatgtcgagttggtggataagattttcggtagtaatacccgtaaacgtaatattatgttggccgatgagattactgaggaattttctcaccgtcaattaaatgatacgcgttacatcgcacgctttatgaaaggtattttgtcaaatattgttcgtgaaaagaacgctgaggggactctcgagccggaagagacgtcaaagaaccttatcgtatgcagcggacgcattacggatcgtgtgaaacaggattggggcttgaatgatatctggaatcacattattaccccacgcttcgagcgcttaaataagaaaactagcagcaatgacttcggtgagtatgtatgtaaagagggaaagcgctactttcagacccgcgtaccgctgaaccttcagaaaggttttaataagaaacgtattgatcaccgtcatcatgcgatggacgcaatcgcaatcgcatgtattaaccgttcaattgtgaattatcttaataacgcagctgcgaatcagactgagcgtgaggatctgcgtcgcgcggtatgtatcccggagcgcaatggtcaaacgaagcgtcagctgcgcagtccgtggcactgcttcgcgcgcgatgccgagaatgcattgcgccagattgtcgtatctttcaaacaaaacttacgtgtggctacgaaggcaactaatagctatgagtgcttcgatacggccagcggaaagaagattcgcaagcatcaatcaaatcgcgagcattatgcgatccgcaagcctctgcataaggacagtgtgtatggcgaggtaattcttacgtcgattgcgagtgtgaacctgaagaaagcgctcctgaaggcggagcgcatcttggataagcgccttaaagaaaagattttcgaacttcgcaagttgtataactacagtaataagcagatcgaagagcacttaaccaaagtatgcattaactgccccgagtggaagaattatgactttaagaaaatcgcagtacgtatcctgagtaatgacgcggacgcaacccatatcgtagcaatccgcaagccactggatgagtcattcgacgaagtgaagattaatacgattactgataccggtattcagaaaatccttctgaatcatttgtcacgctatgcggacgatcccaagaaggcgttcagtcctgagggaattgaggatatgaacgcaaatattgcgtcattgaatggtggcaaacagcacttaccgatttacaaagttcgcgtgtccgagaaggataatggcggatactttccgatcggacagaagggcaaccgcccaaagaagtacgttaccactgcgaaggacacgaatctgttcttcgcagtctacgccgattccaagggtaaacgttcatataaaacgatcgacttacgtaccgctattgagtgtcgcaagcaggggctgagtgtcgcgccttctattaatgagaaaggggataagcttttgtttaccctgagcccgaatgatctggtgtacatgccatcagagggtgaggaagcgaatggcttcgcaattgataataacctgaataaggatcagatttacaaaatggtatccgcgaataataagcagtgtttcttcatcccacatacggttgctgatttcattagtcgcggtgaggagtataactctcacaataaaatcgagttgaccgaggatcgccgtagtattaaggaacactgtgtaccgttgaaggtaaatcgtttgggaaag

SEQ ID NO: 5587 - DNA, 4131 bp, Artificial Sequence
  Description of Artificial Sequence: Synthetic polynucleotide
  MG23-1 sequence codon optimized for E. coli
atgggcaagaagatgtacgttggtttggatatgggtactagttccgttggtctggcagtgacggatgagaactataagttataccgtgttaaaggtaaagactattggtgctctcgtaccttcgacgaagctgacacggcggtggaacgccgcactaatcgtattagccgccgccgtcgccaacgcgaagtggcacgtttggggattttgcgcgaattgttcgcagacgagatcgcaaaggtcgatccgggtttctacgcccgcctggatgaatccaaataccacctggaagatcgcgataacaagcaaccgtacgcaatcttcgccgacaaaggttacaccgacaaggagtattacgcacgttatcccacaatcttccacctgcgttcagaactcattgatagcgataaacctcatgatgtacgtttggtgtacttagcactggcgaatatgtttaagcatcgcggtcacttcctgaatgacagtttatcgagtgacaagccactggcggataccacggaagcctatagcaacttttactatactgcgtccgaactgagtatttcgtttcctgccgaagcacaaccggacagtatcgacgcagcttccctggaagccctgttgggcgataagggagtcagccgtacggacaaagccaagaatatctgtcagtatctggcgattgataagaagacgtcaaaacccctgtacacactgatcaatttaatctgtggcttgaacatcaagctcattgatatttacggggccgagctgatcgatgaggagaataagaagctttcgatcggctttcgtgatagttcgtacgagcaacaagatgcggacggtcgtaaattattaggagagaattacgctattatcgacgcggcgaaggagcttcatgacattggactgctgagcagtatcatgaagggatataagtacctgagccaagcgcgtgtagccctgtacgaggaacacgcggccgacttaaagaaactgaagagtgtgctgaagcgttacgataaagactcgtaccgtaaggtgtttcgttcgatggatgagggcagttattcggcttacatcggttctgttaattctggtacgaaaattcgtcgtggggttaaagatggtagcgcggacacattttgtaagtccatgaagaaggttctggagaaactgccaaaagacgacatggacgttcagtacctgctggcgaaggcgaccgacagttctctcttgccgaagcaactgaccttcgagaatggcgtgatcccgaaccaattacacgcggcagagatgaaagccatccttcgtcaagccgagaagtatttgccgtttctcttagaaaaggatgagtacgacctgactgtgagccaacgtatcattcaattatttacatttcgtattccgtattacgtaggaccgatcggaaagaaccatgcaggcgagaaaggttataacatttgggctactcgtcgcgcaggcgaggaagatggccgcgtgtacccgtggaacttcgagcaaaagatcgatactaaggcagcagcggagaaattcatcgaacgtatggttcgtcattgtacttatattaatggagaacgtacccttccgaagtgtagcttattatacgagaagtatatggtactgaacgaactcaataatctgcgcattaacggggagaagccggcggtgtcagtgaaacaagacatttataccaaactgttttgccgtggcaaacgtgtaacgatgaagatgctgaaagactatctctacaactcgtcccttatcccgtcgaaagaggacgtcgtgatttccgggatcgataatgggtttaatacgtcactgacgagcgtagggaaatttcgtgggatcctgggcgatgcggtgttcgcggatagtaatcaaaagatgattgaagacatcatcttttggggcacagtttacggaaacgataagaaatttctgaaggaacgcattgaagaggtctatggcgatcgccttaaccacgacgagattaagcgcatcttaggctttaactttaacgactggggcaacttaagccgtgagttcctggaactggaaggggagtgcgaatgtggtcgctgttccatcatccaggcccaatggaacacgaaccacaacctgatggaattacttagcgatcaatttaccttcaagaacgaactggagaagaagacgggatcagcggagaaagcgttagcggattggagcatcgacgatttagaggggaagtatctgtctgcgccggttaagcgtatgatttggcaaacgattaagatgttacgcgaagtgtgcgaagttacaggccgtaccccggacaaagtgttcgtcgagatggcgcgtgaagatggtgagaaaggcgctcgtactgtgagtcgtaagaagaaactgttagatctctacgatgccattaagcacgaggagcgtgaattagcaaaggtgtttagcgacgagatcgattctaagactgaggcagactttcgtagtaagaagctctacctctattatctgcaacagggtcgttgcatgtattccggcgacattatccacctgtcagatttaatgaacgataacctgtacgacattgatcacatttaccctcgtcacttcattaaggacgattccctggagaataacctggtactggtaaagaagcaaatcaataatcgtaaacaagacacctttcctattgaacgttcgatccaagaggacatgcgtcccttttggaagtcgcttgccgattcgggattcatttcagcggaaaagtacaaacgcctgactcgtcgcgacgcctttacggacgaagagaaagcggcctttatttcgcgtcaactggtagagacgcgtcaaggcaccaaggcgattgcagacatcctgaagcaagcactgccagacacggagattgtgtacgtcaaggctgggttagtatctgactttcgccaaaagttcgaactttataaagtgcgtgccctcaacgacactcaccatgcgaaggatgcatatttgaatattgtggtgggtaatacttattccaccaaattcacgaacaacccgctcaatttcatcaaggcgggcgctaaacgtccacaagataatcaatttaagtacaacatggataagattttcgattataacgtgattagtcgtggagaacgtgcatggatcgctggttccgacggcagcatctgtacggtgaagaaattcatgagtcgtaacacggtactgatcacccgtaaagcaaaggaagttcatggcgcgctttcaaataaggcgaccatctggggcaagaacgtggcgaaacccggtgcctacttacccgtgaagtcaactgacctgaaagcgcaagacgtaaccaaatatggtggtatcacgagtatcgcgaatagcggctacaccctcgctgaatacaaggttaatggtaagactacgcgtagtcttgaggcgctgccagtgtatctgggtcgtgctgagcaattaaccgaaaagactgtcgtggactatctgtcttcgtccctgcaggaaagttcgaagaagaagatcgaagacattcaggtccgtaaactgtttatcccacaaggttccaaggtgaagatcgatggcttttgctactacctgggcggtaagaccggcgacagcatctacctgaacaacgcagtgcctttgtatttatccagcactagcgaggagtatctgcgtaaactcctgaaggccgtggaaaataacaattataatgagcgcgacaagaatggtcagatcatcctgaccgcgccgaagaatgtccagctgttgtcgtcgatcttcgacaaattacgttcgaaaccgttctccaacaataagtggaacatttatttcagcatcgtgaacggcaaggagaccaaggtggagcaacttttcagtaagctgagcatcgacaaacaggcggaagtaatctcccaaattgtgatttggatcaactcaagccgtcagaatgtgaacctgagcctgatcggcggttcggcgcacagcggcacgcaagcgctcagtaagaccgtgtcgcgtctgaacgagtgtatgctgattagccagtctatcaccggaatttacgaacactctgtggatttattaacaatc

SEQ ID NO: 5588 - DNA, 3075 bp, Artificial Sequence
  Description of Artificial Sequence: Synthetic polynucleotide
  MG1-4 sequence codon optimized for Human
atgaagaagaaagtgttcgcctttgatctgggaaaggccagcattggttactgtgttcgcgatggattcaacatcaatgaagcaaactctataatcatcgataaggaccatgctgagactatgagtctgagagatcgtcggagaatcaagaaaacattagacgcacatcatgccagggaagagtactttaataaagtctggagcggcgtgggcctcaacatactggacaagaacaacaataattttaaaaaagagtttcctagcaaaaatgaggacgtaatttatacttcttgcctgctgcgcatcgctcttctccagaaccaaaagctggaggaatggcagatctacaaagccctgtacaacgcatttcagaggaggggatatgatgtcaacatcgcctggaagagtgtccaaacagatgacgataaggagaacatcgagaggatgaaaaaatacacttgcgagaacgacatagaacttattatctcagacgaatacaagtatccatgctattacgatgcacttcggctcggactgtggaatgaagacgaaccaaccaagcttaaccgttctatcccccagcataattctaataaagtgcgaaccacagaatacgtggccccacgtgaactggtggagaaggaattaaagcagttgtggttaaacgcccagctccagttacctcaattgaattctatatccgccgaagagttcctgtatggcgagtacaagatcccctacggctcatgcgtgcaaaaagaattcaagcagtacagagggactaaaaaagactggcagggggttctctgtcagaagatacctcgcttcgacaaccgcatcattgccaagtgcaagctgcttcccaagaggaatgtgtgcaaagcgaatacaatcgagaatgtgtcatttgtgttactgatgaagctgaagaacctgcgattcaccgtgatctccggagaaaagttacgcctgtctccagtacagatcaagcagatttatgagaactggctggaaaaggtggaggacacttataataaggacctcgagaaggcagaaaagctcgggaaagaaaatcctgagaagagactgaacatcacaatcactcggcaggaaattgagaagataatcggtgaaaaaattatcgacaaaatagaacccatgaaggctgacatctcaggcagatcatctttctgtcgaagagcttgccagattatgaacaaaatcattctggacggcgaactctatcctcagaatgtggatataagcgaattcgtcgaccgggataatgctaagaacggcatcacagaagaagagatccagtctatgctctccaaaattggtgattggaacaatctgtacatccccgataatcgggaggagaatgcgcagaatgcctcaaatagtcgaatcaagacagatatcatgttggggaacattaccaatcctatcgtgcgcaaccgcctgcagatattccgggacctgctcttaaaccttgccgaaaagtacgggacccctgatgaggtgatcttcgaattcgttcgagatggagctgacaacagcttgtatgggtcaaagaaagcccaggacacagagcggtttatgaaacaacaagagaaagagaacgaacagatcataaacgaactcaaggatgctggactctacgtcaatggacagaatcacgcgaatgcaacgtacttcctgatgcacaagctgctgaagtcacaaggaggcaaatgtatttattctggacaaaacatttcccctagtaattacgacgaatgcgagatagaccatatttacccaagaactctcgggggcaatgatgcattgtataacaaagtggtatgctaccgccgcgaaaatcaggataagaaaggtagaactccttacgaatggctcagtcctgactcagacaagtgggcaaattacgtcaaccgtttgaacaagatcaagaagcagcttggtaagaaaaaattcgagctcctgacatccaaaccagaagactgtgaaaaactgatcgaatcttacaacggactcgccgagacgtctcacatcgctcgtgtagcacagcaaatgacagccttcatcttcggatggggactccaaatccagggcgaatcccggaggatcttcgttaataatgggagcagcacatgtgcaatcagaaaacgctacggattaaacaaactgctgggcgataacctcaagaagaaccgcagcaacgataaacaccacgctcttgacgcaatctgtatctctttcagcagggactttaaatacgataaggaaattaagaaagacatcatcaagggattcaacccggagatagtcaagaacgcaattgataagatcatgccctacccttacgctaacgataagcccttcaaggggaacacaaagcctttggaaacgatctacggactgcggacttacggtgataagagttatattactcaacgggtggagctgaacagcatcgacaagaaggctaccaaaatcaagagtatcattgatgagactatcaagaacgacctgttgaataagctgaaggaaaacccgaccgaacaggaatggaaattgatgctccagaattatatccatcctaaaaagcagaccaaggtgaaaaaggttatgatctccgtttcagagggtgaaatcacaaaagactcaaacaacagagaacgcatgggagagtttgttgacttcgggactaagggaactcagcatcagtttaaacattccaaaaggcataaaggacagatcctgtactttaacgagaaaggtgttgtggaggtgatgccggtgtattccaacattaaaacaacagacgtcaaggacaaactgcaaaacatgggctgtaaactgtataacaagggccagatgttttactctgggtgtctggttgacatcccgaagccttttaaggccggatcaaaggagtaccccgcaggtcgttatcagataaagaccattcggtccgacaaagtggcagaacttgaagatgcgtgtggcaataagatcagtacaaatgtcaaatacctggtgccagccgagtttaagaaggttgagtcaaaa

SEQ ID NO: 5589 - DNA, 3177 bp, Artificial Sequence
  Description of Artificial Sequence: Synthetic polynucleotide
  MG1-6 sequence codon optimized for Human
atggaaaaagaaaagaacaaccatgtgtggggttttgatattgggaagggcagtctgggcgaagcagtgcgagtgggcggcgattttaagcacattgcctccgttctgcttgacccggagtttggagaaattaaaaccgccgctctcgcccgcaggcagatgcgcacgcgcaaggcccataaggcaagggaaaaatggctggaggagtgcctggatggaactggagttgagatcttaaagcgtcgtgaggttgggatagttgatggacagtggcggttgatatcaaaaggcgatgaacgcttggagcgggaattcccacccaatggcgaagaagtgtgctataatagtattgccctgcgttgtaaactgctcctgggagagaagctggaaggatggcaagtcttcaaggccttaaattctgcgatccaaaagaggggttacgatgaaaatatcccctggggcgaggctgaagagaagtccagcaagaaggacgaggacgactacgctcaaaagctgtcccagtacgagcgcgagaaaagtgaattgtttgagtctttcgctgacggagagaagtatgatttcccttgtttcttcaaagcatacaaaatggggttgtggagccccgaaaaccccagacgcgttgaggttaggatcgactgcagagctcaaaaagctaagtcctatgttgtagccagaaagtatgttgaaagggaattcgaatgtctggttgaagcggccgccaaatttttccccaagctcaagggccgagcaaagttcatcttgtacggcgtgagcgagactccctacgcgagctattacgggaacatgaggaaaaaattcggtcttaaacgaggcgcggagagcgattggaccgcactcgggcagaaagttccccgattcgataataggattatcgacaagtgcagattgataccacggatgaacgtttgcaaaatccggccactgaacgaggcccgtaacgagaaagatctgttgtactacgaagtgaccttagctttgaagttacttaatcttagattcttccgcaactcaaatatagagcaactcacatttgaagagtttaagaaagcatttgagattgcctccggagccaagtataagatgacgaagactgccatgaaaaaatttctgaagtccatcagcgccactgcactcggagacgactacgccgaaattgaacctcccaaagagtcagggagagcatccttctcacggcctgctatggacattttaaaggaattgattttctctgggatgccccctagagagttctacggacgcaaaattccagagatctccaacaccgacaagaataagggtgtggtggcgagtgatttagattttatcaaactcatgggcgattgtccctggggaggcatttttataccagacgtgcagacttaccagtttgctaacgctgctttccccaatcccgacgctcaaattaataaattgatcggctcacagaataacccgatagttagacatcggttgaccttctttttcgaacgaattaagttcctggaatcaaagtatggagtccccgacaaggtggtgttggagttcgtgcgggacgacttcatgggcgagaaggaaaagaaggagatgagaatcgccatgaaaaagcgggccgaagagaagatgatgattgccaaggatctggacgagcatgggttcaagggcggcaacctccttctgaagatggaattgtatcgtaaacagaacggaatttgtctgtacacaggagacgccctccctcttagtgaactcgcaactctggagatagaacacattgtgcctaggtcccgtggcggacctgacgctcaatacaattacgtgatcacaagggaaaagaccaacaaattgaagggggacaagaccccatacgagtggctcagcagcgatgccaaagaatgggccagctacacagaccgcgtgaatgcatgtgcaaaagcccttggaaagaagcgttgcaggctgttgctggaaaaagacgccgaggagctggtggaaaagtacacagctcttgctgaaaccgcacatattgccaaactggcccaaaagattgtatgtatgcacttcggattccagtttggaggattgagcggaacaaagcgggtcttcaccgttccaggcgctctgacaagtaggatccgtaagttctacggactcgatagaattctccataatgccgcggccgagtcagagaacctgagttttgaagaatttctcaaattcagtgaggacttggaaaagaaaaacaggaaaaacaaaaaacatcacgctctggatgctatgtgtctgtgctttgcccctactggagtggacagccggagggccaagctgggggaaatcctccccgagaaactgcgtagcgagaaagccgccagagagtttttcaagtcctatctggataagatcatgcccgtcgatgttgctccaaagaaacctcggctggaggacggaatctacagcaaaagaatcatcggcgggaaggcctgcatggtgaagaggaataacctggttgatctggcatacaagtcaggcctgaaacctgtcttcgatattccaaccctcatcaagctcgtggataagaaggagaagggaatcatcaatccacagattaggaaaatgattggggaattcgctgccactaaccctgacgagtccgcttggaggaaatggtgtgaggaggtccgtctgcccagtaaaagcgggcttggtgccagggtcctgcgggttctcgtgtactacggcgaggctgacgagtacaaggacctcagcaaagatgggtgcggcgcctacaggaagggagacgggcataagggacaagtggtatgggagtccgtggatggaaagtactatgtcgagcctgtctacgtccacgcctccaaggctggcgtcatggcagccttgaacgcgaatccgaaaaaaaagagaatttgcggaatgttcaatagccactgcacggtagacgtgggagacgtttataacgatcgaggcgattttattttgcccgcaggaagatatatggttaacactatcctgacaacaggcaggtgcgtattaacaaatgcagacggcgaaaaaagaaacccaatcaacattaactaccttatgcgagctgggatgcggcgggtcgaactgtcagagttg

SEQ ID NO: 5590 - DNA, 3402 bp, Artificial Sequence
  Description of Artificial Sequence: Synthetic polynucleotide
  MG3-6 sequence codon optimized for Human
atgtccacagatatgaagaattatcggatcggtgtggacgtgggcgatcggtcagtgggcttggcggctatagaattcgatgacgacggcctccctattcagaagctggccttggtaacattccggcacgatggggggctggatcctaccaaaaataaaactccgatgagccgtaaagagactcgaggaattgccaggcgcacaatgcgcatgaatcgtgagcggaagagaagattaaggaacctcgacaacgtgttagagaatctgggttacagcgtgcccgagggaccagagcccgagacatacgaggcctggacatctagggccctcctggcttccattaagctggcctccgctgacgagctgaatgagcaccttgtcagagccgttaggcacatggctagacaccgcgggtgggctaatccttggtggagcctggatcagctggagaaggccagccaggagccttctgagacttttgagataatccttgcccgtgctcgcgagcttttcggcgagaaggttcctgccaaccccaccctgggtatgttgggggctttagcagctaataacgaggttctcttgcgcccccgtgatgaaaagaagcggaagactggctatgttagaggtactccactcatgtttgcgcaagtccggcagggcgatcagttggctgagcttagacgaatttgcgaagtacaaggcatagaggaccaatacgaagcactgcgcctgggggtgttcgatcataagcacccttatgtgcctaaagagagggtgggcaaagaccctctgaatccgagcacaaacaggaccattcgggcaagtttggagtttcaagaatttaggatcctggactcagttgctaacctccgtgtgaggatcggtagccgggcgaagagagaactcaccgaagcggaatacgacgccgcggttgagttcttgatggattatgccgacaaggaacagccatcctgggccgatgtcgccgagaagataggggtccccggcaatagactcgtggcccccgtgctcgaagatgtccagcaaaagacagccccctatgatcgctccagtgcagcatttgaaaaagcaatgggcaagaagaccgaagccaggcaatggtgggaatccacggacgacgaccagctgaggtccttgttgatagcttttttggtagacgctactaatgataccgaggaagcagccgcggaagcaggcctgtccgagttgtataaaagttggcccgctgaagagcgcgaggccctctccaacatcgattttgaaaagggccgagtggcatattcacaagaaacactgtccaaactgtctgagtatatgcatgagtatcgcgtaggcctgcacgaggcacggaaggctgtattcggggtggacgacacctggcggcctccattagacaagctcgaagaaccaactggtcagccagccgtggatcgcgtcctgaccattcttagaaggtttgtattggattgcgaacgccagtggggccgcccccgcgcgatcacagtggagcacacacggaccggccttatggggccaactcagcggcagaaaatcctgaatgagcagaaaaagaaccgagccgataacgagcgtattcgggatgagttgcgcgagtccggagtggataacccaagccgggctgaggtacgaagacatttgatcgtgcaggagcaggaatgtcagtgtctttattgcgggaccatgatcaccaccacaacctctgaactcgatcacatagtgccacgggcagggggagggtcatccagacgagaaaacctcgccgccgtatgtcgggcctgcaacgctaagaagaagcgagagctcttctacgcttgggccggacctgtgaagagccaagaaaccatcgaaagagtgcgccagttgaaggctttcaaggactctaagaaagccaagatgttcaagaaccagatccgcaggctgaaccagactgaagcagacgaaccaattgacgagcgctctttggcttccacctcctatgctgctgttgctgtcagagaaaggctggaacagcattttaacgagggcctggccctggacgacaagtctcgggtggttcttgacgtgtatgccggggccgtgacccgtgagagtcgtagggctggtggcatagacgaacgcattttgttgagaggggagcgggacaagaaccgttttgatgtgagacatcacgcagtggacgcggccgtgatgaccctgttaaacagatctgtggccctcacgcttgaacagcggtcacagctccgcagaacattttatgagcaaggtctggacaagttagacaggaatcaactcaaacctgaagaagactggcgcgatttcacggggctcgcacccgcctctcaggagaagtttctggaatggcggaaggctgccactatcctgggcgacctcttagcggaggccatcgaagacgactctatcgcggtcgtaagcccacttcgtctgcggccacagaatggaagcgtccacctcgagacaataagcgcagtgaaaaaacaaacgttgggatcagattggcccgccgacgcggtcaaacgtatagtggaccctgagatctacttagcaatgaaggatgccctgggaaagctgaaagagttgcccgaagacagcgctcgctccctggaacttccagatggacgatttgtggaggccgatgacgaggtgcttttttttccagaaaacgcagcaagcattctgactccccgcggagtggccgagatcggaggctccattcaccatgcacgtctgtacggatggctgacgaagaagggtgagttgaaggttgggatgcttagggtttatggagcagagttcccatggttgatgagagagtccggtagcagaaacgtgctgtccatgcctatccaccgcggcagtcagagctttcgggatatgcaggataccacacggaaggcagtggagagtggcgaagctgtcgagttcgcttggatcacccagaatgacgagctcgaatttgaccccgatgactatatcgcccatggcggaaaagatgagttgagacaattcctcggctttatgcctgagtgtcgctggagggttgatggtttcaaaaagaactatcaaattcggatacgccccgctatgctgtccagagagcaactgccatccgatatccagaggaggctggaatcaaagacactgacgaaaaatgaatccctcctgctgaaggctctggataccggcctggtagtggcaattgggggcctgctgccactcgaaacgctgaaggttatccgtaggaacaacctcggattcccccggtggagaggaaacgggaatttgcccacgtccttcgaggtgaggagtagcgctctgagggccctcggagtggagggc

SEQ ID NO: 5591 - DNA, 3393 bp, Artificial Sequence
  Description of Artificial Sequence: Synthetic polynucleotide
  MG3-7 sequence codon optimized for Human
atgagcgaacatactaaatacagaatcggcatcgacgtgggagatcgatctgtgggattagcagccatcgagtttgatgacgatggatttcccctgtcaaacctggcgatggtaacgtataggcacgacggtggactggatcctacgaccaacaaatcacctaaaagcaggaaagagacaaggggtgtggctctccgaacaatgaggatgcggcgcagaaagaaaagccgcctgaaggatctcgacaaaaccctgcgagccctcggatatgtggttcccgcatgtgaggagccccagacatacgaggcttggaaaagcagggccctgctggccacgacaaaggttgagggggcccaagagctgggagaacatctggtacgggcagtgaggcatatggcccgtcatcgcggctggagaaacccatggtggactttcaatcagctggagatcgcgagcaccgctccttcagatacatttgcaaagatccgcgagcgggccgaaaaagaatggcctggagtggtgcccgaggaagccaccctggggatgattggcgcccttgcagcctctaataatgtgttgctgcgccctaggacctaccggaaggatcagccacggcactcaaagaaactgaatgttctgggacaagagcctatcctggtggacaaagtacgccaggaggacctccttgcagagcttcggacaatttgtaaaaagcaagacattgaggatcagtacgagaaattagcgcaggcagtattcgagcagacaaggccctacgttccactggatagggtcggcaaggatcccttgcaaccaaataagtcccgcgcctcacgcgcatccctggagtttcagcgcttccgcattcttgacgctgtggcgcatcttagagtgagggtgggggcgtcagaccgccgggcgctgacagacgaagagcacgataaagccgtccatttcctgatgggctacagtaagaaagacgtgccaacttggggtgatgtggcagacgagattggtgtcgagcccgcccatttaattgccccagtgatcgatgacgtgcgcttgaataaggcgccttatgatcgctccagcaccgaatttgaacagaaaatgaaaaagaagacaagagccagacagtggtgggacgaagctaatctggaatcccgtagtcaactgattctcttagtctctgaccctactgatgagacgatgcgcctcgccgaggtgtccggtctgtatgaggtgttcgagtcctggcctgacgaagaaaaggaggcactcgagggcctcaaggtcgaatctggcagggcagcttactctaccgatactttgaataagcttagcgaccatatgcgactcaaaagaatcgatttacacgaggcccgcaaaattgcgtttggcgttgacgacatgtggcacccaccactggataggatagacgaacccactggacagccgactgtcgatagggtgctgactatcgtgaggcggtttattttcgattgcgaacgcgcttgggggtgtcccgaaaatgttgtgatcgaacatgcgcgcacaggcttgatgggcccggcgcagagggctgacgtcctcaacgagatcgcaaagaacagaaagaaaaatgacaaaattcgagaagatctccgggccggaggaatcaacaaccctacccgcgcagacattcgcagaaatgcgattgtacaggatcaggagagccagtgcctgtactgcggagctacgataggcgtgagctactcagagctcgatcacatcgttcccagagctggcggcggtagttcccgccgggaaaacctcgctgcagtctgccgggcatgtaatgatagtaagaaagatacaccatttgccgtgtgggccaagaataccagtagacccgtgacgttggagggaacaatacagcggcttagggagcttaaagccttcaagcggcctaaggaccggagaatggtggatctgataatacggcgactgaagcagactgaaaaggacgatcccattgatgagcgaagcctggcctctacaagctacgcagctaccgccatcagagagcgcatcgagcagtatttcaatgagaaggctgagaagctcgacttggccaaagtgcatatcgacgtgtattccggatcattgaccagagaatcaaggagggccggggggatcgacaaaatggttcttttaaggggtcagtccgataagaacagattcgatgtgcgacaccatgcaatcgacgccgctgtccttactctgctgaataggtctgtcgcggtcaccctggagcaacgccgactgatcaaacaacagcgggaatattctctcgagaagtcccggagagaaagggataatgtgtggcgcgattttatgggactgggtccggccgcccaggaaaagtttgccaagtggaagaagactgcttacgtgctggccgatatcatcaaagaggcaatttcaaatgacgcaatccctgttgtcagccccctccggctgcgtcctcaaaatggatctgtgcaccttgacaccgttgatgccgtgctcgaaagaactattggcgatgcatggactgtcgaccaggtgcatcggatagtcaacccacagatctatctggcctttgccggatacttgggaaatcagaaggccctggaccctgacagcagcagagtccttgccttaaacgacggcaggaaactcacagcggaagacgtgatctatgtgttccctgagaaagccgcctccattttaacccctaggggagtcgtaaaaataggggagagcgtacatcacgtgcggctgtacgcttggaagaataggaaggggaaagcagaggtcgggatgctcagagtgtttggcgcagagtttccttggctgatgcgagagagcggggtaaaagatgtgctcagggtacctattcatacgggcagtcagtcctacagagacttgtcctttactgtgcgcaagaacatagaaaaaggcgaggcggccgagattggatggttgacacaaaacgaggagcttgagttcaatcctgaaagctacttgcaggaaggaggcaaagataaactggctaaattcctcgcatttctccccgagactcgctggcgcgttgatgggtttcctatgcccgataagcttcggattcggcctgctcttctctcacgcgaggaaatcccagaaggtgtgttccggaccgaagaacagagtcttctggaagaggctctcaccaaggggctgataattgcaactaaagggctcttgtctctccctgacgtgaaagtcttgcgccggaacaacctcggcattccgcggtggcggggtggatcctacagacccgtttccctggatatccagagggccgcactggcagctctggatgaacaggag

SEQ ID NO: 5592 - DNA, 960 bp, Unknown
  Description of Unknown: uncultivated organism with predicted taxonomy: unclassified Verrucomicrobia
  MG1-1 species 16S rRNA gene
acggagagtttgattctggctcagaacgaacgctggcggcgtggataagacatgcaagtcgagcgggatacacagggtagcaatattctgtgtgttcagcggcgcaagggtgcgtaacacgtgggtaatttgccatgaagtctggaataacttgctgaaaggcgagctaatgccggatgtgacttccgaaaggcatcttttggaattcaaagttggggaccttaaccggcctgacgctttttgataagcccgcggtctatcagctagttggtgaggtaacggctcaccaaggctaagacggatagctggtctgagaggacgaccagccacactggaactgagacacggtccagacacctacgggtggcagcagtcgagaatttttcacaatgggcgaaagcctgatggagcgacgccgcgtgggggatgaatggcttcggcccgtaaacccctgtcatttgcgaacaaaccttactggtaaacaaccagtgagctgattgtagcggaagaggaagggacggctaactctgtgccagcagccgcggtaatacagaggtcccgagcgttgttcggattcactgggcgtaaagggtgcgtaggtggtgaggtaagtcggatgtgaaatctccgggctcaacccggaaatggcattggaaactaccttgcttgaggatttgaggggggattagaatacttggtgtagaagtgaaatgcgtagatatcaagtggaacaccagtggcgaaggcgaatccctggaaaatacctgacactgaggcacgaaagctaggggagcaaacaggatgagataccctggtagtcctagccctaaacggtgcttgcttgctgtaagaggaatcgacccctcttgtggcggagctaacgcgttaagcaagccgcctgggaagtacggtcgcaagattaaaactcaaagaaattgacgggggcctgcacaagcggtg

SEQ ID NO: 5593 - DNA, 1527 bp, Unknown
  Description of Unknown: uncultivated organism with predicted taxonomy: unclassified Verrucomicrobia
  MG1-2 species 16S rRNA gene
tcggagagtttgattctggctcagaacgaacgctggcggcgtggataagacatgcaagtcgaacgggatcattccggttggcaacaatcggggtgattcagtggcgaacgggtgcgtaacacgtgggaatctgcccggaagagggggatagcccgccgaaaggcggattaataccgtatatattgaaagtgggggaccgcaaggcctcacacttccggatgagcccgcgtcctatcagctagttggtggggtaatggcccaccaaggctttgacgggtagctggtctgagaggacgaccagccacactgggactgagacacggcccagacacctacgggtggcagcagtcgagaatttttcacaatgggggaaaccctgatggagcgacgccgcgtggaggatgaagggcttcggctcgtaaactcctgtcaccacagacaaatgattcacggtgaacatccgtgaagcttgatggtatgtggagaggaagggacggctaactctgtgccagcagccgcggtaatacagaggtcccaagcgttgttcggatttactgggcgtaaagggtgcgtaggaggtctggaaagtcgggtgtgaaatctcaccgcctaacggtgaaattgcgctcgaaactcccagactcgaggaccggagaggagaacggaattcctggtgtagcggtgaaatgcgtagatatcaggaggaacaccaacggcgaaggcagttctctggaaggttcctgactctgaggcacgaaggccaggggagcaaacgggattagataccccggtagtcctggcagtaaacggtgctcattaggtgtaggcggattcgaccccgtctgtgccgcagctaacgcgttaaatgagccgcctggggagtacggtcgcaagattaaaactcaaagaaattgacgggggcccgcacaagcggtggagtatgtggcttaattcgatgcaacgcgaagaaccttacctggtcttgacatgcattgttcatccgtggaaacacggtggcccgcaagggcgaattgcacaggtgctgcatggctgtcgtcagctcgtgtcgtgagatgttgggttaagtcccgcaacgagcgcaacccctatgattagttatatgcgcaagctcactagtcagactgccctgttcaacggggaggaaggtggggatgacgtcaagtcaggatggcccttatgaccagggctgcacacgtactacaatgcccactacagagggtcgcgaagccgtgaggtggagccaatcccagaaaagtgggcccagttcggatcggaggctgcaactcgcctccgtgaagttggaatcgctagtaatggcgcatcagctacggcgccgtgaatacgttcccgggccttgtacacactgcccgtcacatcatgaaagccggttgtacccgaagtcgtttggctaaccgcaaggaggccggcgcctaaggtatggctggtgattgggatgaagtcgtaacaaggtagccgtaggggaacctgcggctggatcacctcctt

SEQ ID NO: 5594 - DNA, 1472 bp, Unknown
  Description of Unknown: uncultivated organism
  MG1-3 species 16S rRNA gene
taagagtttgatcctggctcaggattaacgctggcgggatgcctaacacatgcaagtcgagcggcagcacttcgggtggcgagcggcggacggctgaggaacacgttggtacctgccccaaactcagggataagccttcgaaaggaggtctaataccggatatccggaaacgggaaagatttatcggtttgggaggggcctgcgtcgtatcatgcttgttggtggggtaatggctcaccaaggctttgacgcgtatctggtgtgagagcatgaccagacagagtgggactgagacacggcccacactcctacgggaggcagcagtgaggaattttccgcaatggacgaaagtctgacggagcaatcccgcgtggaggacgacacctttcggggcgtaaactccttttctgagggaagaaattttgacggtacctcaggaataagcatcggctaactacgtgccagcagccgcggtaatacgtaggatgcaagcgttatccggaattactgggcgtaaagcgttcgaaggtggtgatatcagtctggtgttaaatccctgcggctcaaccgaggaatcgtaccggatactgtatcactagaggaatgcagaggaagctggaattcccattgtaggggtaaaatccgtagataatgggaggaacaccaaaagcgaaggcaggcttctgggcatttcctgacactgcgcgaacgaaagcgtggggagcgaaagggattagatacccctgtagtccacgccctaaacgatgatcactcgatatacgccggctcaatcccggtgtgtgtccaagctaacgcgttaagtgatccgcctgtggagtacggccgcaaggctaaaacataaaggaatagacggggatccacacaagcggtggagcatggggtttaattcgacagtaagcgaggaaccttaccaagacttgacatctttcgaattttctagaaatagaaaagtgccttcgggaacgaaatgacaggtgctgcatggttgtcgtcagctcgtgccttgaggtgtgcggttaagtccgtgaacgagcgcaaccctcgtcgtgtgttgtatttttcacacgagactgcccgttttacgcgggaggaaggtgaggatgacgtcaaatcagcatggcccttatgtcttgggcgacacccgtgctacaatggccggtacaaagggcagccaacccgcgagggggagcgaatcccaaaaagccggtctcagttcggattgaagtctgcaactcgacttcatgaagctggaatcgctagtaaccgtgaatcagccacgtcacggtgaatatgttcctggatcttgtactcaccgcccgtcaagtcacgaaaggtgggggcgcccgaagccgtgttatcccctcggggagcatgaccacggtgaaaccactgattgggactaagtcgtaacaaggtatccgtaggggaatctgcggatggatcacctcctt

SEQ ID NO: 5595 - DNA, 1542 bp, Unknown
  Description of Unknown: uncultivated organism with predicted taxonomy: unclassified Verrucomicrobia
  MG1-6 species 16S rRNA gene
acggagagtttgattctggctcagagtgaacgctggcggcgtggttaagacatgcaagtcgagcgagaacaaaagcgtagcaatacgtggatgagaaagcggcgaacgggtgcgtaacacgtaagcaacctgccctaaagacggggatagctcggggaaactcgaattaataccggatgtggtccttaaacacatgtaagaggaactaaagcttgagaaggcgctttaggaggggcttgcggcctatcagctagttggtaaggtaacggcttaccaaggcaaagacgggtagcgggtctgagaggacgatccgccacactggaactgagacacggtccagacacctacgggtggcagcagtttcgaatcattcacaatgggggcaaccctgatggtgcaacgccgcgtgggggacgaaggtcttcggattgtaaacccctgtcacacaggactaaccgcaaggttcatagccttgtctgaattaactgtgagaggaagtagtggctaactccgtgccagcagccgcggtaatacggagactacgagcgttactcggattcactgggcgtaaagggagcgcaggcgggatagtgtgttaggtgtgaaatgccggggcttaacttcggagctgcgcctaaaactattattctagagtgctggagaggtaagcggaatttccggtgtagcggtaaaatgcgcagatatcggaaggaacaccgaaggcgaaggcagcttactggacagaaactgacgctcatgctcgaaagcgtggggagcgaaagggattagatacccctgtagtccacgccctaaacgttgtacactaggtattggaggaatcatccccttcagtgccccagctaacgcgataagtgtaccgcctgaggactacgaccgcaaggttaaaactcaaagaaattgacgggggcccgcacaagcggtggagcatgtggcttaattcgatgcaacgcgaagaaccttacctgggtttgacatgtatttgaatatatgtgaaagcatatagtccttcgggacaggtacacagatgctgcatggctgtcgtcagctcgtgtcgtgagatgttcggttaagtccggcaacgagcgcaaccctcgccctatgttaccagcgggtaaagccggggactcttaggggacaagcctgtatacaggcgggaaggtggggatgacgtcaagtcagtatggctcttacatccagggctgcacacgtgctacaatggccgacacagagggatgctacgtcgcgaggcgatgcgaatctcgaaaatcggtctcagttcggattggatgtctgcaactcgactccatgaagccggaatcgctagtaaaggcgtatcagctacgacgccttgaatacgttcccgggccttgtacacaccgcccgtcaagtcatgaaagccggttttgcccgaagttcgtgagctaacccgcgaggggggcagcggcctaaggcaatgctggtgattgggactaagtcgtaacaaggtagccgtaggggaacctgcggctggatcacctcctt

SEQ ID NO: 5596 - RNA, 28 nt, Artificial Sequence
  Description of Artificial Sequence: Synthetic oligonucleotide
  test target sequence
cgugagccaccacgucgcaagccucgac

SEQ ID NO: 5597 - protein, 7 aa, Simian virus 40
  SV40 NLS
PKKKRKV

SEQ ID NO: 5598 - protein, 16 aa, Homo sapiens
  nucleoplasmin bipartite NLS
KRPAATKKAGQAKKKK

SEQ ID NO: 5599 - protein, 9 aa, Homo sapiens
  c-myc NLS
PAAKRVKLD

SEQ ID NO: 5600 - protein, 11 aa, Homo sapiens
  c-myc NLS
RQRRNELKRSP

SEQ ID NO: 5601 - protein, 38 aa, Mus sp.
  hnRNPA1 M9 NLS
NQSSNFGPMKGGNFGGRSSGPYGGGGQYFAKPRNQGGY

SEQ ID NO: 5602 - protein, 42 aa, Homo sapiens
  Importin-alpha IBB domain NLS
RMRIZFKNKGKDTAELRRRRVEVSVELRKAKKDEQILKRRNV

SEQ ID NO: 5603 - protein, 8 aa, Murine polyomavirus
  Myoma T protein NLS
VSRKRPRP

SEQ ID NO: 5604 - protein, 8 aa, Murine polyomavirus
  Myoma T protein NLS
PPKKARED

SEQ ID NO: 5605 - protein, 8 aa, Homo sapiens
  p53 NLS
PQPKKKPL

SEQ ID NO: 5606 - protein, 12 aa, Mus sp.
  mouse c-abl IV NLS
SALIKKKKKMAP

SEQ ID NO: 5607 - protein, 5 aa, Influenza virus
  influenza virus NS1 NLS
DRLRR

SEQ ID NO: 5608 - protein, 7 aa, Influenza virus
  influenza virus NS1 NLS
PKQKKRK

SEQ ID NO: 5609 - protein, 10 aa, Hepatitis delta virus
  Hepatitis virus delta antigen NLS
RKLKKKIKKL

SEQ ID NO: 5610 - protein, 10 aa, Mus sp.
  mouse Mx1 protein NLS
REKKKFLKRR

SEQ ID NO: 5611 - protein, 20 aa, Homo sapiens
  human poly(ADP-ribose) polymerase NLS
KRKGDEVDGVDEVAKKKSKK

SEQ ID NO: 5612 - protein, 17 aa, Homo sapiens
  steroid hormone receptors glucocorticoid NLS
RKCLQAGMNLEARKTKK

SEQ ID NO: 5613 - protein, 1053 aa, Staphylococcus aureus
  J7RUA5_CAS9_STAAU (aligned to MG1-2, 6)
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 5614 - protein, 1101 aa, Actinomyces naeslundii
  J3F2B0_CAS9_ACTNH_4ogc (aligned to MG3)
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 5615 - protein, 9 aa, Unknown
  Description of Unknown: uncultivated organism
  MG1-1 to 1-3 MOTIF
RHHALDAMV

SEQ ID NO: 5616 - protein, 9 aa, Unknown
  Description of Unknown: uncultivated organism
  MG1 motif 2.1
KHHALDAMC

SEQ ID NO: 5617 - protein, 9 aa, Unknown
  Description of Unknown: uncultivated organism
  MG1 motif 2.2
KHHALDAIC

SEQ ID NO: 5618 - protein, 8 aa, Unknown
  Description of Unknown: uncultivated organism
  MG1 motif 3
  MOD_RES (2)..(2): Any amino acid
PXGFSRPA

SEQ ID NO: 5619 - protein, 8 aa, Unknown
  Description of Unknown: uncultivated organism
  MG1 motif 4
  MOD_RES (2)..(2): Any amino acid
PXGFCRPA

SEQ ID NO: 5620 - protein, 8 aa, Unknown
  Description of Unknown: uncultivated organism
  MG1 motif 5
  MOD_RES (2)..(2): Any amino acid
PXGYCRPA

SEQ ID NO: 5621 - protein, 8 aa, Unknown
  Description of Unknown: uncultivated organism
  MG1 motif 6
  MOD_RES (2)..(2): Any amino acid
PXGYSRPA

SEQ ID NO: 5622 - protein, 10 aa, Unknown
  Description of Unknown: uncultivated organism
  MG1 motif 7
  MOD_RES (8)..(9): Any amino acid
PIVRHRLXXF

SEQ ID NO: 5623 - protein, 10 aa, Unknown
  Description of Unknown: uncultivated organism
  MG1 motif 8
  MOD_RES (8)..(9): Any amino acid
PVVRHRLXXF

SEQ ID NO: 5624 - protein, 10 aa, Unknown
  Description of Unknown: uncultivated organism
  MG1 motif 9
  MOD_RES (8)..(9): Any amino acid
PLVRHRLXXF

SEQ ID NO: 5625 - protein, 13 aa, Unknown
  Description of Unknown: uncultivated organism
  MG1 motif 10
  MOD_RES (5)..(5): Any amino acid
  MOD_RES (10)..(10): Any amino acid
FKALXSAIQXRGY

SEQ ID NO: 5626 - protein, 13 aa, Unknown
  Description of Unknown: uncultivated organism
  MG1 motif 11
  MOD_RES (5)..(5): Any amino acid
  MOD_RES (10)..(10): Any amino acid
FKALXNAIQXRGY

SEQ ID NO: 5627 - protein, 13 aa, Unknown
  Description of Unknown: uncultivated organism
  MG1 motif 12
  MOD_RES (5)..(5): Any amino acid
  MOD_RES (10)..(10): Any amino acid
YKALXSAIQXRGY

SEQ ID NO: 5628 - protein, 13 aa, Unknown
  Description of Unknown: uncultivated organism
  MG1 motif 13
  MOD_RES (5)..(5): Any amino acid
  MOD_RES (10)..(10): Any amino acid
YKALXNAIQXRGY

SEQ ID NO: 5629 - protein, 7 aa, Unknown
  Description of Unknown: uncultivated organism
  MG1 motif 14
LKLLNLR

SEQ ID NO: 5630 - protein, 7 aa, Unknown
  Description of Unknown: uncultivated organism
  MG1 motif 15
MKLLNLR

SEQ ID NO: 5631 - protein, 11 aa, Unknown
  Description of Unknown: uncultivated organism
  MG1, MG2 motif 1
  MOD_RES (4)..(4): Any amino acid
  MOD_RES (9)..(10): Any amino acid
PRFXNRIIXXC

SEQ ID NO: 5632 - protein, 11 aa, Unknown
  Description of Unknown: uncultivated organism
  MG1, MG2 motif 2
  MOD_RES (4)..(4): Any amino acid
  MOD_RES (9)..(10): Any amino acid
PRFXNRILXXC

SEQ ID NO: 5633 - protein, 7 aa, Unknown
  Description of Unknown: uncultivated organism
  MG2 motif 1
NNHLVRH

SEQ ID NO: 5634 - protein, 7 aa, Unknown
  Description of Unknown: uncultivated organism
  MG2 motif 2
NNHLIRH

SEQ ID NO: 5635 - protein, 7 aa, Unknown
  Description of Unknown: uncultivated organism
  MG2 motif 3
NNHIVRH

SEQ ID NO: 5636 - protein, 7 aa, Unknown
  Description of Unknown: uncultivated organism
  MG2 motif 4
  MOD_RES (4)..(4): Any amino acid
EFLXFRW

SEQ ID NO: 5637 - protein, 7 aa, Unknown
  Description of Unknown: uncultivated organism
  MG2 motif 5
  MOD_RES (4)..(4): Any amino acid
EFLXYRW

SEQ ID NO: 5638 - protein, 7 aa, Unknown
  Description of Unknown: uncultivated organism
  MG2 motif 6
  MOD_RES (4)..(4): Any amino acid
EFMXFRW

SEQ ID NO: 5639 - protein, 8 aa, Unknown
  Description of Unknown: uncultivated organism
  MG3 motif 1
EPQTYEAW

SEQ ID NO: 5640 - protein, 8 aa, Unknown
  Description of Unknown: uncultivated organism
  MG3 motif 2
EPETYEAW

SEQ ID NO: 5641 - protein, 9 aa, Unknown
  Description of Unknown: uncultivated organism
  MG3 motif 3
HLVRAVRHM

SEQ ID NO: 5642 - protein, 8 aa, Unknown
  Description of Unknown: uncultivated organism
  MG3 motif 4
  MOD_RES (4)..(4): Any amino acid
MRMXRRKK

SEQ ID NO: 5643 - protein, 8 aa, Unknown
  Description of Unknown: uncultivated organism
  MG3 motif 5
MRMRRRRK

SEQ ID NO: 5644 - protein, 8 aa, Unknown
  Description of Unknown: uncultivated organism
  MG3 motif 6
  MOD_RES (2)..(3): Any amino acid
NXXLLRPR

SEQ ID NO: 5645 - protein, 15 aa, Unknown
  Description of Unknown: uncultivated organism
  MG3 motif 7
  MOD_RES (2)..(2): Any amino acid
  MOD_RES (13)..(14): Any amino acid
QXDVLAELRRICXXQ

SEQ ID NO: 5646 - protein, 15 aa, Unknown
  Description of Unknown: uncultivated organism
  MG3 motif 8
  MOD_RES (2)..(2): Any amino acid
  MOD_RES (13)..(14): Any amino acid
QXDLLAELRTICXXQ

SEQ ID NO: 5647 - protein, 15 aa, Unknown
  Description of Unknown: uncultivated organism
  MG3 motif 9
  MOD_RES (2)..(2): Any amino acid
  MOD_RES (13)..(14): Any amino acid
QXDQLAELRRICXXQ

SEQ ID NO: 5648 - protein, 11 aa, Unknown
  Description of Unknown: uncultivated organism
  MG3 motif 10
  MOD_RES (3)..(4): Any amino acid
VPXXRVGKDPL

SEQ ID NO: 5649 - protein, 10 aa, Unknown
  Description of Unknown: uncultivated organism
  MG4 motif 1
  MOD_RES (5)..(5): Any amino acid
  MOD_RES (8)..(8): Any amino acid
QQFRXLQXVN

SEQ ID NO: 5650 - protein, 9 aa, Unknown
  Description of Unknown: uncultivated organism
  MG14 motif 1
  MOD_RES (2)..(2): Any amino acid
HXDGTSRAL

SEQ ID NO: 5651 - protein, 9 aa, Unknown
  Description of Unknown: uncultivated organism
  MG14 motif 2
  MOD_RES (2)..(2): Any amino acid
HXNGTSRAL

SEQ ID NO: 5652 - protein, 9 aa, Unknown
  Description of Unknown: uncultivated organism
  MG14 motif 3
  MOD_RES (2)..(2): Any amino acid
HXGGTSRAL

SEQ ID NO: 5653 - protein, 9 aa, Unknown
  Description of Unknown: uncultivated organism
  MG14 motif 4
  MOD_RES (2)..(2): Any amino acid
HXDGSEQAL

SEQ ID NO: 5654 - protein, 7 aa, Unknown
  Description of Unknown: uncultivated organism
  MG14 motif 5
  MOD_RES (5)..(5): Any amino acid
SELVXAY

SEQ ID NO: 5655 - protein, 7 aa, Unknown
  Description of Unknown: uncultivated organism
  MG14 motif 6
  MOD_RES (5)..(5): Any amino acid
SEMVXAY

SEQ ID NO: 5656 - protein, 7 aa, Unknown
  Description of Unknown: uncultivated organism
  MG14 motif 7
  MOD_RES (5)..(5): Any amino acid
SELCXAY

SEQ ID NO: 5657 - protein, 10 aa, Unknown
  Description of Unknown: uncultivated organism
  MG14 motif 8
  MOD_RES (5)..(8): Any amino acid
FKGVXXXXEK

SEQ ID NO: 5658 - protein, 10 aa, Unknown
  Description of Unknown: uncultivated organism
  MG14 motif 9
  MOD_RES (5)..(8): Any amino acid
FKGIXXXXEK

SEQ ID NO: 5659 - protein, 8 aa, Unknown
  Description of Unknown: uncultivated organism
  MG14 motif 10
  MOD_RES (6)..(6): Any amino acid
LADAVXEA

SEQ ID NO: 5660 - protein, 8 aa, Unknown
  Description of Unknown: uncultivated organism
  MG14 motif 11
  MOD_RES (6)..(6): Any amino acid
LGDAVXEA

SEQ ID NO: 5661 - protein, 8 aa, Unknown
  Description of Unknown: uncultivated organism
  MG14 motif 12
  MOD_RES (6)..(7): Any amino acid
EEPEVXXL

SEQ ID NO: 5662 - protein, 8 aa, Unknown
  Description of Unknown: uncultivated organism
  MG14 motif 13
  MOD_RES (6)..(7): Any amino acid
EEPEIXXL

SEQ ID NO: 5663 - protein, 8 aa, Unknown
  Description of Unknown: uncultivated organism
  MG14 motif 14
  MOD_RES (6)..(7): Any amino acid
EDPEVXXL

SEQ ID NO: 5664 - protein, 11 aa, Unknown
  Description of Unknown: uncultivated organism
  MG14 motif 15
  MOD_RES (5)..(5): Any amino acid
  MOD_RES (7)..(7): Any amino acid
  MOD_RES (9)..(10): Any amino acid
NPVVXRXMXXM

SEQ ID NO: 5665 - protein, 11 aa, Unknown
  Description of Unknown: uncultivated organism
  MG14 motif 16
  MOD_RES (5)..(5): Any amino acid
  MOD_RES (7)..(7): Any amino acid
  MOD_RES (9)..(10): Any amino acid
NPVVXRXTXXV

SEQ ID NO: 5666 - protein, 14 aa, Unknown
  Description of Unknown: uncultivated organism
  MG14 motif 17
  MOD_RES (2)..(2): Any amino acid
  MOD_RES (4)..(4): Any amino acid
  MOD_RES (6)..(7): Any amino acid
  MOD_RES (10)..(10): Any amino acid
  MOD_RES (12)..(12): Any amino acid
DXRXYXXVGXCXYF

SEQ ID NO: 5667 - protein, 14 aa, Unknown
  Description of Unknown: uncultivated organism
  MG14 motif 18
  MOD_RES (4)..(4): Any amino acid
  MOD_RES (6)..(8): Any amino acid
  MOD_RES (13)..(13): Any amino acid
VLYXLXXXRGYIXH

SEQ ID NO: 5668 - protein, 12 aa, Unknown
  Description of Unknown: uncultivated organism
  MG15 motif 1
  MOD_RES (2)..(2): Any amino acid
  MOD_RES (4)..(6): Any amino acid
DXIXXXFSVYKN

SEQ ID NO: 5669 - protein, 10 aa, Unknown
  Description of Unknown: uncultivated organism
  MG15 motif 2
YSRACERAGY

SEQ ID NO: 5670 - protein, 8 aa, Unknown
  Description of Unknown: uncultivated organism
  MG15 motif 3
VKRSISQT

SEQ ID NO: 5671 - protein, 8 aa, Unknown
  Description of Unknown: uncultivated organism
  MG15 motif 4
VKRAISQT

SEQ ID NO: 5672 - protein, 13 aa, Unknown
  Description of Unknown: uncultivated organism
  MG15 motif 5
  MOD_RES (9)..(9): Any amino acid
  MOD_RES (12)..(12): Any amino acid
KACYKILPXLEXG

SEQ ID NO: 5673 - protein, 13 aa, Unknown
  Description of Unknown: uncultivated organism
  MG15 motif 6
  MOD_RES (9)..(9): Any amino acid
  MOD_RES (12)..(12): Any amino acid
KACYKLLPXLEXG

SEQ ID NO: 5674 - protein, 8 aa, Unknown
  Description of Unknown: uncultivated organism
  MG15, MG21 motif 1
  MOD_RES (6)..(6): Any amino acid
QKLIPXLE

SEQ ID NO: 5675 - protein, 8 aa, Unknown
  Description of Unknown: uncultivated organism
  MG15, MG21 motif 2
  MOD_RES (6)..(6): Any amino acid
RKLIPXLE

SEQ ID NO: 5676 - protein, 16 aa, Unknown
  Description of Unknown: uncultivated organism
  MG16 motif 1
  MOD_RES (2)..(4): Any amino acid
  MOD_RES (7)..(8): Any amino acid
  MOD_RES (11)..(12): Any amino acid
WXXXKAXXKGXXGNTT

SEQ ID NO: 5677 - protein, 16 aa, Unknown
  Description of Unknown: uncultivated organism
  MG16 motif 2
  MOD_RES (2)..(4): Any amino acid
  MOD_RES (7)..(8): Any amino acid
  MOD_RES (11)..(12): Any amino acid
WXXXKAXXKGXXGNAT

SEQ ID NO: 5678 - protein, 16 aa, Unknown
  Description of Unknown: uncultivated organism
  MG16 motif 3
  MOD_RES (2)..(4): Any amino acid
  MOD_RES (7)..(8): Any amino acid
  MOD_RES (11)..(12): Any amino acid
WXXXRAXXKGXXGNTT

SEQ ID NO: 5679 - protein, 14 aa, Unknown
  Description of Unknown: uncultivated organism
  MG18 motif 1
WITLFCDEKKMLVT

SEQ ID NO: 5680 - protein, 11 aa, Unknown
  Description of Unknown: uncultivated organism
  MG18 motif 2
HTNKNFMELLS

SEQ ID NO: 5681 - protein, 11 aa, Unknown
  Description of Unknown: uncultivated organism
  MG18 motif 3
HTNKNLMELLS

SEQ ID NO: 5682 - protein, 20 aa, Unknown
  Description of Unknown: uncultivated organism
  MG18 motif 4
IKAIKKLKYKDWGRLSATLL

SEQ ID NO: 5683 - protein, 21 aa, Unknown
  Description of Unknown: uncultivated organism
  MG18 motif 5
CTYLVGEDVLPKESLLYSEFM

SEQ ID NO: 5684 - protein, 18 aa, Unknown
  Description of Unknown: uncultivated organism
  MG18 motif 6
TVDGERLPVDVLEKIFKQ

SEQ ID NO: 5685 - protein, 17 aa, Unknown
  Description of Unknown: uncultivated organism
  MG18 motif 7
  MOD_RES (11)..(11): Any amino acid
EQGRCWVVRKXEKIYPW

SEQ ID NO: 5686 - protein, 11 aa, Unknown
  Description of Unknown: uncultivated organism
  MG18 motif 8
QNIGGIDDKIN

SEQ ID NO: 5687 - protein, 10 aa, Unknown
  Description of Unknown: uncultivated organism
  MG21 motif 1
  MOD_RES (4)..(5): Any amino acid
  MOD_RES (7)..(7): Any amino acid
SYHXXRXALD

SEQ ID NO: 5688 - protein, 22 aa, Unknown
  Description of Unknown: uncultivated organism
  MG21 motif 2
  MOD_RES (5)..(5): Any amino acid
  MOD_RES (11)..(11): Any amino acid
  MOD_RES (15)..(15): Any amino acid
  MOD_RES (19)..(21): Any amino acid
NPVVXRAVSQXIKVXNAVXXXY

SEQ ID NO: 5689 - protein, 20 aa, Unknown
  Description of Unknown: uncultivated organism
  MG21 motif 3
  MOD_RES (5)..(6): Any amino acid
  MOD_RES (8)..(8): Any amino acid
  MOD_RES (11)..(11): Any amino acid
  MOD_RES (14)..(14): Any amino acid
  MOD_RES (17)..(17): Any amino acid
CTFEXXEXRAXKAXYTXEYF

SEQ ID NO: 5690 - protein, 14 aa, Unknown
  Description of Unknown: uncultivated organism
  MG21 motif 4
  MOD_RES (3)..(3): Any amino acid
  MOD_RES (6)..(7): Any amino acid
  MOD_RES (10)..(10): Any amino acid
YDXACXXVYXDHRG

SEQ ID NO: 5691 - protein, 14 aa, Unknown
  Description of Unknown: uncultivated organism
  MG21 motif 5
  MOD_RES (3)..(3): Any amino acid
  MOD_RES (6)..(7): Any amino acid
  MOD_RES (10)..(10): Any amino acid
YDXACXXIYXDHRG

SEQ ID NO: 5692 - protein, 6 aa, Unknown
  Description of Unknown: uncultivated organism
  MG21 motif 6
KLLQDL

SEQ ID NO: 5693 - protein, 14 aa, Unknown
  Description of Unknown: uncultivated organism
  MG21 motif 7
  MOD_RES (2)..(2): Any amino acid
  MOD_RES (5)..(6): Any amino acid
  MOD_RES (9)..(9): Any amino acid
  MOD_RES (13)..(13): Any amino acid
EXAYXXILXSQRXF

SEQ ID NO: 5694 - protein, 11 aa, Unknown
  Description of Unknown: uncultivated organism
  MG22 motif 1
  MOD_RES (5)..(5): Any amino acid
  MOD_RES (8)..(9): Any amino acid
WESPXELXXYI

SEQ ID NO: 5695 - protein, 8 aa, Unknown
  Description of Unknown: uncultivated organism
  MG22 motif 2
VEQVSLET

SEQ ID NO: 5696 - protein, 8 aa, Unknown
  Description of Unknown: uncultivated organism
  MG22 motif 3
LRVVRDLW

SEQ ID NO: 5697 - protein, 8 aa, Unknown
  Description of Unknown: uncultivated organism
  MG22 motif 4
LRVVHDLW

SEQ ID NO: 5698 - protein, 8 aa, Unknown
  Description of Unknown: uncultivated organism
  MG22 motif 5
YGAYSKRA

SEQ ID NO: 5699 - protein, 8 aa, Unknown
  Description of Unknown: uncultivated organism
  MG22 motif 6
YGAYSDKA

SEQ ID NO: 5700 - protein, 14 aa, Unknown
  Description of Unknown: uncultivated organism
  MG23 motif 1
VLKKYDAYDEMFRV

SEQ ID NO: 5701 - protein, 14 aa, Unknown
  Description of Unknown: uncultivated organism
  MG23 motif 2
VLKKYNGYDKMFRV

SEQ ID NO: 5702 - protein, 14 aa, Unknown
  Description of Unknown: uncultivated organism
  MG23 motif 3
VLKKYDEYDKMFRM

SEQ ID NO: 5703 - protein, 8 aa, Unknown
  Description of Unknown: uncultivated organism
  MG23 motif 4
  MOD_RES (6)..(6): Any amino acid
GKDLWXSR

SEQ ID NO: 5704 - protein, 8 aa, Unknown
  Description of Unknown: uncultivated organism
  MG23 motif 5
  MOD_RES (6)..(6): Any amino acid
GKDFWXSR

SEQ ID NO: 5705 - protein, 16 aa, Unknown
  Description of Unknown: uncultivated organism
  MG23 motif 6
  MOD_RES (12)..(12): Any amino acid
  MOD_RES (14)..(14): Any amino acid
MVLNELNNLKIXGXKP

SEQ ID NO: 5706 - protein, 16 aa, Unknown
  Description of Unknown: uncultivated organism
  MG23 motif 7
  MOD_RES (12)..(12): Any amino acid
  MOD_RES (14)..(14): Any amino acid
TVLNELNNLKIXGXKP

SEQ ID NO: 5707 - protein, 16 aa, Unknown
  Description of Unknown: uncultivated organism
  MG23 motif 8
  MOD_RES (12)..(12): Any amino acid
MVLNELNNLRIXGKKP

SEQ ID NO: 5708 - protein, 12 aa, Unknown
  Description of Unknown: uncultivated organism
  MG23 motif 9
  MOD_RES (2)..(2): Any amino acid
  MOD_RES (10)..(10): Any amino acid
VXVKQGIYEXLF

SEQ ID NO: 5709 - protein, 12 aa, Unknown
  Description of Unknown: uncultivated organism
  MG23 motif 10
  MOD_RES (2)..(2): Any amino acid
  MOD_RES (10)..(10): Any amino acid
VXVKQDIYEXLF

SEQ ID NO: 5710 - protein, 13 aa, Unknown
  Description of Unknown: uncultivated organism
  MG23 motif 11
  MOD_RES (7)..(8): Any amino acid
  MOD_RES (10)..(11): Any amino acid
GKRVTLXXLXXYL

SEQ ID NO: 5711 - protein, 13 aa, Unknown
  Description of Unknown: uncultivated organism
  MG23 motif 12
  MOD_RES (7)..(8): Any amino acid
  MOD_RES (10)..(11): Any amino acid
GKKVTLXXLXXYL

SEQ ID NO: 5712 - protein, 8 aa, Unknown
  Description of Unknown: uncultivated organism
  MG23 motif 13
  MOD_RES (4)..(4): Any amino acid
FTDXNQAM

SEQ ID NO: 5713 - protein, 13 aa, Unknown
  Description of Unknown: uncultivated organism
  MG23 motif 14
  MOD_RES (7)..(7): Any amino acid
  MOD_RES (10)..(10): Any amino acid
WGTVYGXDKXFLK

SEQ ID NO: 5714 - protein, 13 aa, Unknown
  Description of Unknown: uncultivated organism
  MG23 motif 15
  MOD_RES (7)..(7): Any amino acid
  MOD_RES (10)..(10): Any amino acid
WGTIYGXDKXFLK

SEQ ID NO: 5715 - protein, 13 aa, Unknown
  Description of Unknown: uncultivated organism
  MG23 motif 16
  MOD_RES (7)..(7): Any amino acid
  MOD_RES (10)..(10): Any amino acid
WATIYGXDKXFLK

SEQ ID NO: 5716 - protein, 8 aa, Unknown
  Description of Unknown: uncultivated organism
  MG23 motif 17
ALELLGDE

SEQ ID NO: 5717 - protein, 8 aa, Unknown
  Description of Unknown: uncultivated organism
  MG23 motif 18
AKDILGDE

SEQ ID NO: 5718 - RNA, 7 nt, Artificial Sequence
  Description of Artificial Sequence: Synthetic oligonucleotide
  MG3-7 single guide 3' PAM
  modified_base (1)..(2): a, c, t, g, unknown or other
  modified_base (4)..(4): a, c, t, g, unknown or other
nnrntac

SEQ ID NO: 5719 - DNA, 22 bp, Artificial Sequence
  Description of Unknown: Uncultivated organism
gaagccgagccgagcggagccg

SEQ ID NO: 5720 - DNA, 23 bp, Artificial Sequence
  Description of Unknown: Uncultivated organism
gaaggcaaacatcctgataatgg

SEQ ID NO: 5721 - DNA, 22 bp, Artificial Sequence
  Description of Unknown: Uncultivated organism
atcaaactgtgagcatcttcag

SEQ ID NO: 5722 - DNA, 22 bp, Artificial Sequence
  Description of Unknown: Uncultivated organism
cagcgaatctactcagccagag

SEQ ID NO: 5723 - DNA, 22 bp, Artificial Sequence
  Description of Unknown: Uncultivated organism
ctttaacttgtgtgattctgga

SEQ ID NO: 5724 - DNA, 22 bp, Artificial Sequence
  Description of Unknown: Uncultivated organism
agcttaattagctcctttggct

SEQ ID NO: 5725 - DNA, 22 bp, Artificial Sequence
  Description of Unknown: Uncultivated organism
ccatggtgcatctgactcctga

SEQ ID NO: 5726 - DNA, 22 bp, Artificial Sequence
  Description of Unknown: Uncultivated organism
tgcttgagaccgccagaagctc

SEQ ID NO: 5727 - DNA, 22 bp, Artificial Sequence
  Description of Unknown: Uncultivated organism
cgagaacagcccagaagttgga

SEQ ID NO: 5728 - DNA, 22 bp, Artificial Sequence
  Description of Unknown: Uncultivated organism
cggaggagccgtggtccgcgcg

SEQ ID NO: 5729 - DNA, 22 bp, Artificial Sequence
  Description of Unknown: Uncultivated organism
atgtgtgagaaaaatttaatca

SEQ ID NO: 5730 - DNA, 22 bp, Artificial Sequence
  Description of Unknown: Uncultivated organism
aggtccaagtaaaatttgtctt

SEQ ID NO: 5731 - DNA, 22 bp, Artificial Sequence
  Description of Unknown: Uncultivated organism
gtacaaacggcagaagctggag

SEQ ID NO: 5732 - DNA, 22 bp, Artificial Sequence
  Description of Unknown: Uncultivated organism
aggaagggcctgagtccgagca

SEQ ID NO: 5733 - DNA, 22 bp, Artificial Sequence
  Description of Unknown: Uncultivated organism
aagggcctgagtccgagcagaa

SEQ ID NO: 5734 - DNA, 22 bp, Artificial Sequence
  Description of Unknown: Uncultivated organism
gagtgactgaaacttcacagaa

SEQ ID NO: 5735 - DNA, 22 bp, Artificial Sequence
  Description of Unknown: Uncultivated organism
ttctatttatgagatcaacagc

SEQ ID NO: 5736 - DNA, 22 bp, Artificial Sequence
  Description of Unknown: Uncultivated organism
cagatgcaccatggtgtctgtt

SEQ ID NO: 5737 - DNA, 22 bp, Artificial Sequence
  Description of Unknown: Uncultivated organism
gaggccctgggcaggttggtat

SEQ ID NO: 5738 - DNA, 22 bp, Artificial Sequence
  Description of Unknown: Uncultivated organism
aggttggtatcaaggttacaag

SEQ ID NO: 5739 - DNA, 22 bp, Artificial Sequence
  Description of Unknown: Uncultivated organism
tcaactttcctggcaacttgcg

SEQ ID NO: 5740 - DNA, 22 bp, Artificial Sequence
  Description of Unknown: Uncultivated organism
aggaacattcagttaagatagt

SEQ ID NO: 5741 - DNA, 22 bp, Artificial Sequence
  Description of Unknown: Uncultivated organism
tttaaattatgaatccatctct

SEQ ID NO: 5742 - DNA, 22 bp, Artificial Sequence
  Description of Unknown: Uncultivated organism
gagtgactgaaacttcacagaa

SEQ ID NO: 5743 - DNA, 22 bp, Artificial Sequence
  Description of Unknown: Uncultivated organism
gagtgactgaaacttcacagaa

SEQ ID NO: 5744 - DNA, 22 bp, Artificial Sequence
  Description of Unknown: Uncultivated organism
ttctatttatgagatcaacagc

SEQ ID NO: 5745 - DNA, 22 bp, Artificial Sequence
  Description of Unknown: Uncultivated organism
cagatgcaccatggtgtctgtt

SEQ ID NO: 5746 - DNA, 22 bp, Artificial Sequence
  Description of Unknown: Uncultivated organism
gaagttggtggtgaggccctgg

SEQ ID NO: 5747 - DNA, 22 bp, Artificial Sequence
  Description of Unknown: Uncultivated organism
gaggccctgggcaggttggtat

SEQ ID NO: 5748 - DNA, 22 bp, Artificial Sequence
  Description of Unknown: Uncultivated organism
aggttggtatcaaggttacaag

SEQ ID NO: 5749 - DNA, 22 bp, Artificial Sequence
  Description of Unknown: Uncultivated organism
tcaactttcctggcaacttgcg

SEQ ID NO: 5750 - DNA, 22 bp, Artificial Sequence
  Description of Unknown: Uncultivated organism
aggaacattcagttaagatagt

SEQ ID NO: 5751 - DNA, 22 bp, Artificial Sequence
  Description of Unknown: Uncultivated organism
tttaaattatgaatccatctct

SEQ ID NO: 5752 - DNA, 22 bp, Artificial Sequence
  Description of Unknown: Uncultivated organism
gagtgactgaaacttcacagaa

SEQ ID NO: 5753 - DNA, 22 bp, Artificial Sequence
  Description of Unknown: Uncultivated organism
cttattaataaaattcaaacat

SEQ ID NO: 5754 - DNA, 22 bp, Artificial Sequence
  Description of Unknown: Uncultivated organism
gttggtggtgaggccctgggca

SEQ ID NO: 5755 - DNA, 22 bp, Artificial Sequence
  Description of Unknown: Uncultivated organism
ctagttaatggaataaaacatt

SEQ ID NO: 5756 - DNA, 22 bp, Artificial Sequence
  Description of Unknown: Uncultivated organism
gcattataatgcaccaaggctt

SEQ ID NO: 5757 - DNA, 22 bp, Artificial Sequence
  Description of Unknown: Uncultivated organism
gtggcggggtcccaggtgctga

SEQ ID NO: 5758 - DNA, 22 bp, Artificial Sequence
  Description of Unknown: Uncultivated organism
tgtccgccgccggccggggagg

SEQ ID NO: 5759 - DNA, 22 bp, Artificial Sequence
  Description of Unknown: Uncultivated organism
ggtgatgcaccctctgcccgat

SEQ ID NO: 5760 - DNA, 22 bp, Artificial Sequence
  Description of Unknown: Uncultivated organism
ccacatcaactttcctggcaac

SEQ ID NO: 5761 - DNA, 23 bp, Artificial Sequence
  Description of Unknown: Uncultivated organism
gctagttaatggaataaaacatt

SEQ ID NO: 5762 - DNA, 22 bp, Artificial Sequence
  Description of Unknown: Uncultivated organism
gcattataatgcaccaaggctt

SEQ ID NO: 5763 - DNA, 22 bp, Artificial Sequence
  Description of Unknown: Uncultivated organism
tgcttattatggacaagtagca

SEQ ID NO: 5764 - DNA, 22 bp, Artificial Sequence
  Description of Unknown: Uncultivated organism
tccctgaagatgctcacagttt

SEQ ID NO: 5765 - DNA, 22 bp, Artificial Sequence
  Description of Unknown: Uncultivated organism
ttttatttctcctgcatatgat

SEQ ID NO: 5766 - DNA, 22 bp, Artificial Sequence
  Description of Unknown: Uncultivated organism
tgtggggcaaggtgaacgtgga

SEQ ID NO: 5767 - DNA, 22 bp, Artificial Sequence
  Description of Unknown: Uncultivated organism
atggtgcatctgactcctgagg

SEQ ID NO: 5768 - DNA, 22 bp, Artificial Sequence
  Description of Unknown: Uncultivated organism
agaacagcccagaagttggacg

SEQ ID NO: 5769 - DNA, 22 bp, Artificial Sequence
  Description of Unknown: Uncultivated organism
tcctccgaagcgagaacagccc
